US012460001B2

(12) United States Patent
Brittingham et al.

(10) Patent No.: US 12,460,001 B2
(45) **Date of Patent: *Nov. 4, 2025**

(54) PROTEINS COMPRISING CD3 ANTIGEN BINDING DOMAINS AND USES THEREOF

(71) Applicant: Janssen Biotech, Inc., Horsham, PA (US)

(72) Inventors: Raymond Brittingham, Blue Bell, PA (US); Scott R. Brodeur, New Hope, PA (US); Rajkumar Ganesan, Blue Bell, PA (US); Jaclyn Hoover, Conshohocken, PA (US); Steven A. Jacobs, North Wales, PA (US); Colleen M. Kane, Flourtown, PA (US); Jinquan Luo, Malvern, PA (US); Sanjaya Singh, Blue Bell, PA (US); Fang Yi, Collegeville, PA (US); Adam Zwolak, Bala Cynwyd, PA (US); Triveni K. Bhatt, Perkasie, PA (US); Michael Dennis Feldkamp, Blue Bell, PA (US); Sherry Lynn La Porte, Horsham, PA (US)

(73) Assignee: Janssen Biotech, Inc., Horsham, PA (US)

(*) Notice: Subject to any disclaimer, the term of this patent is extended or adjusted under 35 U.S.C. 154(b) by 735 days.

This patent is subject to a terminal disclaimer.

(21) Appl. No.: 17/330,462

(22) Filed: May 26, 2021

(65) Prior Publication Data

US 2022/0411504 A1 Dec. 29, 2022

Related U.S. Application Data

(60) Provisional application No. 63/094,931, filed on Oct. 22, 2020, provisional application No. 63/057,958, filed on Jul. 29, 2020, provisional application No. 63/030,448, filed on May 27, 2020.

(51) Int. Cl.

| | |
|---|---|
| ***C07K 16/28*** | (2006.01) |
| ***A61K 39/395*** | (2006.01) |
| ***A61P 35/00*** | (2006.01) |
| ***C07K 16/30*** | (2006.01) |
| ***C07K 16/42*** | (2006.01) |
| *A61K 39/00* | (2006.01) |

(52) U.S. Cl.

CPC .......... *C07K 16/2809* (2013.01); *A61P 35/00* (2018.01); *C07K 16/3069* (2013.01); *C07K 16/4266* (2013.01); *A61K 2039/505* (2013.01); *C07K 2317/24* (2013.01); *C07K 2317/31* (2013.01); *C07K 2317/40* (2013.01); *C07K 2317/52* (2013.01); *C07K 2317/524* (2013.01); *C07K 2317/526* (2013.01); *C07K 2317/53* (2013.01); *C07K 2317/55* (2013.01); *C07K 2317/565* (2013.01); *C07K 2317/622* (2013.01); *C07K 2317/92* (2013.01); *C07K 2317/94* (2013.01); *C07K 2319/00* (2013.01); *C07K 2319/20* (2013.01)

(58) Field of Classification Search

CPC ............ C07K 16/2809; C07K 16/3069; C07K 16/4266; C07K 2317/24; C07K 2317/31; C07K 2317/565; C07K 2317/622; C07K 2319/00; C07K 16/4208; A61P 35/00; A61K 2039/505

See application file for complete search history.

(56) References Cited

U.S. PATENT DOCUMENTS

| | | | |
|---|---|---|---|
| 4,683,195 | A | 7/1987 | Mullis et al. |
| 5,223,409 | A | 6/1993 | Ladner |
| 5,225,539 | A | 7/1993 | Winter |
| 5,403,484 | A | 4/1995 | Ladner |
| 5,427,908 | A | 6/1995 | Dower |
| 5,571,698 | A | 11/1996 | Ladner |
| 5,580,717 | A | 12/1996 | Dower |
| 5,885,793 | A | 3/1999 | Griffiths |
| 5,932,448 | A | 8/1999 | Tso et al. |
| 5,969,108 | A | 10/1999 | McCafferty |
| 6,150,584 | A | 11/2000 | Kucherlapati et al. |
| 6,172,197 | B1 | 1/2001 | McCafferty |
| 6,180,370 | B1 | 1/2001 | Queen |
| 6,255,458 | B1 | 7/2001 | Longbert et al. |
| 6,521,404 | B1 | 2/2003 | Griffiths |
| 6,521,427 | B1 | 2/2003 | Evans |
| 6,544,731 | B1 | 4/2003 | Griffiths |
| 6,555,313 | B1 | 4/2003 | Griffiths |
| 6,582,915 | B1 | 6/2003 | Griffiths |

(Continued)

FOREIGN PATENT DOCUMENTS

| | | | |
|---|---|---|---|
| CN | 107001468 | A | 8/2017 |
| EP | 0590058 | B1 | 11/2003 |

(Continued)

OTHER PUBLICATIONS

Tsuchiya, Y. The diversity of H3 loops determines the antigen-binding tendencies of antibody CDR loops, Wiley-Blackwell, 25, 815-825, (Year: 2016).*

(Continued)

*Primary Examiner* — Christine J Saoud
*Assistant Examiner* — Jon M Lockard
(74) *Attorney, Agent, or Firm* — Riverside Law LLP

(57) ABSTRACT

The disclosure provides antigen binding domains that bind cluster of differentiation 3 (CD3) protein, comprising the antigen binding domains that bind CD3ε, polynucleotides encoding them, vectors, host cells, methods of making and using them.

50 Claims, 43 Drawing Sheets

Specification includes a Sequence Listing.

(56) References Cited

U.S. PATENT DOCUMENTS

| | | | |
|---|---|---|---|
| 6,593,081 B1 | 7/2003 | Griffiths | |
| 6,670,127 B2 | 12/2003 | Evans | |
| 6,818,749 B1 | 11/2004 | Kashmiri et al. | |
| 6,833,441 B2 | 12/2004 | Wang et al. | |
| 7,709,226 B2 | 5/2010 | Foote | |
| 8,242,247 B2 | 8/2012 | Klein | |
| 8,748,356 B2 | 6/2014 | Raghunathan | |
| 9,150,663 B2 | 10/2015 | Labrijn et al. | |
| 10,100,125 B2 | 10/2018 | Timmermand et al. | |
| 10,465,006 B2 | 11/2019 | Van Den Brink | |
| 2007/0287170 A1 | 12/2007 | Davis | |
| 2009/0182127 A1 | 7/2009 | Kjaergaard | |
| 2010/0015133 A1 | 1/2010 | Igawa | |
| 2010/0028637 A1 | 2/2010 | Tavsanli | |
| 2010/0076178 A1 | 3/2010 | Ghayur et al. | |
| 2010/0261620 A1 | 10/2010 | Almagro et al. | |
| 2011/0123532 A1 | 5/2011 | Gurney | |
| 2012/0149876 A1 | 6/2012 | Von Kreudenstein et al. | |
| 2013/0195849 A1 | 8/2013 | Von Kreudenstein et al. | |
| 2014/0170149 A1 | 6/2014 | Neijssen | |
| 2014/0273092 A1 | 9/2014 | Flikweert et al. | |
| 2014/0303356 A1 | 10/2014 | Gramer et al. | |
| 2017/0121420 A1 | 5/2017 | Heidrich | |
| 2017/0275375 A1 | 9/2017 | Rossi | |
| 2018/0057597 A1 | 3/2018 | Albrecht | |
| 2018/0118849 A1 | 5/2018 | Klein et al. | |
| 2018/0230193 A1* | 8/2018 | Loew | C07K 16/30 |
| 2019/0352421 A1 | 11/2019 | Adams | |
| 2020/0190205 A1 | 6/2020 | Adams | |

FOREIGN PATENT DOCUMENTS

| | | | |
|---|---|---|---|
| EP | 2982693 A1 | 2/2016 | |
| JP | 2015535828 | 12/2015 | |
| JP | 2016529882 A | 9/2016 | |
| JP | 2017504314 | 2/2017 | |
| JP | 2017505121 | 2/2017 | |
| TW | 201527323 A | 7/2015 | |
| WO | 8801649 A1 | 3/1988 | |
| WO | WO 1990/04036 A1 | 4/1990 | |
| WO | 9007861 A1 | 7/1990 | |
| WO | 9201047 A1 | 1/1992 | |
| WO | WO 1992/22653 A1 | 12/1992 | |
| WO | 9413804 A1 | 6/1994 | |
| WO | WO 1996/027011 A1 | 9/1996 | |
| WO | 9844001 A1 | 10/1998 | |
| WO | WO 1999/045962 A1 | 9/1999 | |
| WO | WO 2002/043478 A2 | 6/2002 | |
| WO | WO 2002/066630 A1 | 8/2002 | |
| WO | WO 2002/088172 A2 | 11/2002 | |
| WO | WO 2003/000737 A2 | 1/2003 | |
| WO | 0243478 A3 | 8/2003 | |
| WO | 0243478 A8 | 5/2004 | |
| WO | 2006028936 A2 | 3/2006 | |
| WO | 2006028936 A3 | 9/2006 | |
| WO | WO 2007/147901 A1 | 12/2007 | |
| WO | WO 2008/077546 A1 | 7/2008 | |
| WO | 2009018386 A1 | 2/2009 | |
| WO | 2009080251 A1 | 7/2009 | |
| WO | 2009080252 A1 | 7/2009 | |
| WO | 2009080254 A1 | 7/2009 | |
| WO | WO 2009/085462 A1 | 7/2009 | |
| WO | WO 2009/134776 A2 | 11/2009 | |
| WO | 2011131746 A2 | 10/2011 | |
| WO | WO 2011/123708 A2 | 10/2011 | |
| WO | WO 2011/143545 A1 | 11/2011 | |
| WO | 2011131746 A3 | 12/2011 | |
| WO | WO 2012/022811 A1 | 2/2012 | |
| WO | 2012162067 | 11/2012 | |
| WO | WO 2013/096291 A2 | 6/2013 | |
| WO | WO 2013/157954 A1 | 10/2013 | |
| WO | 2014047231 | 3/2014 | |
| WO | WO 2014/093908 A2 | 6/2014 | |
| WO | 2014093908 A3 | 10/2014 | |
| WO | 2015095392 | 6/2015 | |
| WO | WO-2015181098 A1 * | 12/2015 | C07K 16/2809 |
| WO | 2016116626 | 7/2016 | |
| WO | 2018052503 | 3/2018 | |
| WO | 2019034580 | 2/2019 | |
| WO | 2019057099 | 3/2019 | |
| WO | WO 2019/060695 A1 | 3/2019 | |
| WO | 2019133761 | 7/2019 | |
| WO | 2019175658 | 9/2019 | |
| WO | 2019220369 | 11/2019 | |
| WO | 2019224711 | 11/2019 | |
| WO | 2019224713 | 11/2019 | |
| WO | 2019224717 | 11/2019 | |
| WO | 2019224718 | 11/2019 | |
| WO | 2021019389 | 2/2021 | |

OTHER PUBLICATIONS

Riechmann, L. Single domain antibodies: comparison of camel VH and camelised human VH domains, Elsevier, 231, 25-38 (Year: 1999).*

Fernandez-Quintero, M. L., Germline-Dependent Antibody Paratope States and Pairing Specific VH-VL Interface Dynamics. Frontiers, 12, 675655, (Year: 2021).*

Adan, et al., "Flow cytometry: basic principles and applications", Crit Rev Biotechnol, (2017), vol. 37, No. 2, pp. 163-176.

Alegre, M L et al. "A non-activating "humanized" anti-CD3 monoclonal antibody retains immunosuppressive properties in vivo." Transplantation vol. 57, 11 (1994): 1537-43. (Year: 1994).

Bruggemann, et al., "Human antibody production in transgenic mice: expression from 100 kb of the human IgH locus", Eur. J. Immunol., (1991), vol. 21, pp. 1323-1326.

Bruggemann, et al., "Production of human antibody repertoires in transgenic mice", Current Opinion in Biotechnology, (1997), vol. 8, pp. 455-458.

Chames, et al., "Bispecific antibodies for cancer therapy", Current Opinion in Drug Discovery & Development, (2009), vol. 12, No. 2, pp. 276-283.

Cline, et al., "Perspectives for Gene Therapy: inserting new genetic information into mammalian cells by physical techniques and viral vectors", Pharmac. Ther., (1985), vol. 29, pp. 69-92.

Fishwild et al., "High-avidity human IgGk monoclonal antibodies from a novel strain of minilocus transgenic mice", Nature Biotechnology, vol. 14, No. 7 (1996), pp. 845-851.

Freshney, et al., "Culture of Animal Cells: A Manual of Basic Technique, 3rd edition", Journal of Immunological Methods, (1995), vol. 183, pp. 291-292.

Goding, "Monoclonal Antibodies: Principles and Practice", Academic Press, (1996), pp. 59-103.

Green et al, "Antigen-specific human monoclonal antibodies from mice engineered with human Ig heavy and light chain YACs", Nature Genetics, vol. 7 (1994), pp. 13-21.

Green, "Antibody engineering via genetic engineering of the mouse:XenoMouse strains are a vehicle for the facile generation of therapeutic human monoclonal antibodies", Journal of Immunological Methods, (1999), vol. 231, pp. 11-23.

Green, et al., "Regulation of B Cell Development by Variable Gene Complexity in Mice Reconstituted with Human Immunoglobulin Yeast Artificial Chromosomes", J. Exp. Med., (1998), vol. 188, No. 3, pp. 483-495.

Heinz Kohler et al: "The Promise of Anti-idiotype Revisited", Frontiers in Immunology, vol. 10, Apr. 1, 2019.

Hoogenboom, et al., "By-passing Immunisation Human Antibodies from Synthetic Repertoires of Germline VH Gene Segments Rearranged in Vitro", J. Mol. Biol., (1992), vol. 227, pp. 381-388.

Huang, J., et al., "Recruitment of IRAK to the interleukin 1 receptor complex requires interleukin 1 receptor accessory protein", Proc. Natl. Acad. Sci., (1997), vol. 94, vol. 24, pp. 12829-12832.

International Search Report relating to corresponding International Patent Application No. PCT/IB2019/054188, filed May 21, 2019. Date of Mailing of International Search Report: Jan. 23, 2020.

International Search Report and Written Opinion for PCT/IB2021/054582.

(56) References Cited

OTHER PUBLICATIONS

Janeway, Charles A. "Immunobiology: The Immune System in Health and Disease." 2001 (Year: 2001).
Janeway, Charles A. "Immunobiology: The Immune System in Health and Disease." 2005 (Year: 2005).
Kim et al., "Synthesis of Bispecific Antibodies using Genetically Encoded Unnatural Amino Acids." J. Am. Chem. Soc. 2012, 134, 24, 9918-9921.
Kipriyanov, Sergey M., and Fabrice Le Gall. "Generation and production of engineered antibodies." Molecular biotechnology 26.1 ( 2004): 39-60. (Year: 2004).
Krebs, B., et al., "High-throughput generation and engineering of recombinant human antibodies", Journal of Immunological Methods, (2001), vol. 254, pp. 67¬84.
Labrijn, A.F., et al., "Controlled Fab-arm exchange for the generation of stable bispecific IgG1", Nature Protocols, (2014), vol. 9, No. 10, pp. 2450-2463.
Labrijn, A.F., et al., "Efficient generation of stable bispecific IgG1 by controlled Fab-arm exchange", PNAS, (2013), vol. 110, No. 13, pp. 5145-5150.
Labrijn, Aran F et al. "Therapeutic IgG4 antibodies engage in Fab-arm exchange with endogenous human IgG4 in vivo." Nature biotechnology vol. 27,8 (2009): 767-71. doi:10.1038/nbt.1553 (Year: 2009).
Lathey, J.L., et al., "Production and characterization of an anti-idiotypic antibody specific for a monoclonal antibody to glycoprotein D of herpes simplex virus", Immunology, (1986), vol. 57, pp. 29-35.
Lefranc, M.P., et al., "IMGT®, the international ImMunoGeneTics information system®", Nucleic Acids of Research, (2009), vol. 37, pp. D1006-D1012.
Lonberg et al. "Antigen-specific human antibodies from mice comprising four distinct genetic modifications", Nature, vol. 368 (1994), pp. 856-859.
Lonberg et al., "Human Antibodies from Transgenic Mice", International Reviews of Immunology, vol. 13, No. 1 (1995), pp. 65-93.
Marks, J.D., et al., "By-passing Immunization Human Antibodies from V-gene Libraries Displayed on Phase", J. Mol. Biol., (1991), vol. 222, pp. 581-597.
Mendez, et al., "Functional transplant of megabase human immunoglobulin loci recapitulates human antibody response in mice," Nature Genetics, vol. 15, No. 2 (1997), pp. 146-156.
Nunez-Prado, N., et al., "The coming of age of engineered multivalent antibodies", Drug Discovery Today, (2015), vol. 20, No. 5, pp. 588-594.
Okayama, H., et al., "A cDNA Cloning Vector That Permits Expression of cDNA Inserts in Mammalian Cells", Molecular and Cellular Biology, (1983), vol. 3, No. 2, pp. 280-289.
Pascal, B.D., et al., "HDX Workbench: Software for the Analysis of H/D Exchange MS Data". J. Am. Soc. Mass SDectrum. (20121. vol. 23. Daaes 1512-1521.
Rich, Rebecca L, and David G. Myszka. "Higher-throughput, label-free, real-time molecular interaction analysis." Analytical biochemistry 361.1 (2006): 1-6. (Year: 2006).
Sela-Culang, Inbal, Vered Kunik, and Yanay Ofran. "The structural basis of antibody-antigen recognition." Frontiers in Immunology 4 (2013): 302 (Year: 2013).
Sheets, et al., "Efficient construction of a large nonimmune phage antibody library: The production of high-affinity human single-chain antibodies to protein antigens", Proc. Natl. Acad. Sci., (1998), vol. 95, pp. 6157-6162.
Sugita et al., "Inhibition of T cell-mediated inflammation in uveitis by a novel anti-CD3 antibody." Arthritis Res Ther. Jul. 25, 2017;19(1):176.
Thalmann, et al., "Androgen-independent Cancer Progression and Bone Metastasis in the LNCaP Model of Human Prostate Cancer", Cancer Research, (1994), vol. 54, pp. 2577-2581.
Troy, D.B., "Remington: The Science and Practice of Pharmacy", 21st Edition, Lippincott, Williams & Wilkins, (2006), Table of Contents.
Vaughan, et al., "Human Antibodies with Sub-nanomolar Affinities Isolated from a Large Non-immunized Phage Display Library", Nature Biotechnology, (1996), vol. 14, pp. 309-314.
Wranik, B.J., et al., "LUZ-Y, a Novel Platform for the Mammalian Cell Production of Full-length IgG-bispecific Antibodies", Journal of Biological Chemistry, (2012), vol. 287, 52, pp. 43331-43339.
Written Opinion of the International Searching Authority relating to corresponding International Patent Application No. PCT/IB2019/054188, filed May 21, 2019. Date of Mailing of Written Opinion: Jan. 23, 2020.
www.Rockland-Inc.com: "Anti-Idiotypic Antibody Production Service", , Nov. 12, 2019 (Nov. 12, 2019), XP055642733, Retrieved from the Internet: URL:https://rockland-inc.com/anti-idiotypic-antibody-production.aspx.
Yang, X.D., et al., "Eradication of Established Tumors by a Fully Human Monoclonal Antibody to the Epidermal Growth Factor Receptor without Concomitant Chemotherapy", Cancer Research, (1999), vol. 59, pp. 1236-1243.
Ying et al., "Anti-idiotypic antibodies: biological function and structural studies.", The FASEB Journal, Federation of American Societies For Experimental Biology, Jan. 1, 1995, pp. 43-49, vol. 9(1), XP002526815.
Baert et al., "Influence of Immunogenicity on the Long-Term Efficacy of Infliximab in Crohn's Disease.", N. Engl. J. Med, 2003, pp. 602-608, vol. 348(7).
Cai et al., "C-Terminal Lysine Processing of Human Immunoglobulin G2 Heavy Chain In Vivo.", Biotechnol Bioeng, Feb. 2011, pp. 404-412, vol. 108(2).
Carosella et al., "Beyond the increasing complexity of the immunomodulatory HLA-G molecule.". Blood, 2008, pp. 1864-4870, vol. 111.
Carosella et al., "HLA-G: An Immune Checkpoint Molecule.", Adv Immunol, Chapter 2, 2015, pp. 33-144, vol. 127.
Chen, L. & Flies, D. B., "Molecular mechanisms of T cell co-stimulation and co-inhibition.", Nat Rev Immunol, Apr. 2013, pp. 227-242, vol. 13.
Chothia and Lesk, "Canonical Structures for the Hypervariable Regions of Immunoglobulins.", Mol Biol, 1987, pp. 901-917, vol. 196.
Clements et al., "Crystal structure of HLA-G: a nonclassical MHC class I molecule expressed at the fetal-maternal interface.", Proc Natl Acad Sci U S A, Mar. 1, 2005, pp. 3360-3365, vol. 102(9).
Ferrara et al., "Modulation of Therapeutic Antibody Effector Functions by Glycosylation Engineering: Influence of Golgi Enzyme Localization Domain and Co-Expression of Heterologous β1,4-N-acetylglucosaminyltransferase III and Golgi α-mannosidase II.", Biotechnol Bioeng, 2006, pp. 851-861, vol. 93.
Ferrara et al., "The Carbohydrate at FcY RIIIa Asn-162. An Element Required For High Affinity Binding To Non-Fuscosylated IgG Glycoforms*.", J Biol Chem, 2006, pp. 5032-5036, vol. 281(8).
Gadi et al., "In vivo sensitization of ovarian tumors to chemotherapy by expression of *E. coli* purine nucleoside phosphorylase in a small fraction of cells.", Gene Ther., 2000, pp. 1738-1743, vol. 7.
Honegger and Plückthun, "Yet Another Numbering Scheme for Immunoglobin Variable Domains: An Automatic Modeling and Analysis Tool.", J Mol Biol, 2001, pp. 657-670, vol. 309.
Juch et al., "A novel sandwich ELISA for alpha1 domain based detection of soluble HLA-G heavy chains.", J Immunol Methods, 2005, pp. 96-106, vol. 307.
Kim et al., "Heterodimeric CD3eg Extracellular Domain Fragments: Production, Purification and Structural Analysis." J Mol. Biol., 2000, pp. 899-916, vol. 302(4).
Kjer-Nielsen et al., "Crystal structure of the human T cell receptor CD3ay heterodimer complexed to the therapeutic mAb OKT3.", Proc Natl Acad Sci USA, May 18, 2004, pp. 7675, vol. 101(20).
Knappik et al., "Fully Snythetic Human Combinatorial Antibody Libraries (HuCAL) Based on Modular Consensus Frameworks and CDRs Randomized with Trinucleotides.", J Mol Biol, 2000, pp. 57-86, vol. 296.
Konno et al., "Fucose content of monoclonal antibodies can be controlled by culture medium osmolality for high antibody-dependent cellular cytotoxicity.", Cytotechnology, 2012, pp. 249-265, vol. 64.

(56) References Cited

OTHER PUBLICATIONS

Labrijn et al., “Bispecific antibodies: a mechanistic review of the pipeline.”, Nat Rev Drug Discov, Aug. 2019, pp. 585-608, vol. 18.
Lee et al., “The membrane-bound and soluble forms of HLA-G bind identical sets of endogenous peptides but differ with respect to TAP association.”, Immunity Nov. 1995, pp. 591-600, vol. 3.
Lefranc et al., “IMGT unique numbering for immunoglobulin and T cell receptor variable domains and Ig superfamily V-like domains.”, Dev Comparat Immunol, 2003, pp. 55-77, vol. 27.
MacLennan et al., “Structure-Function Relationships in the Ca2+-Binding and Translocation Domain of SERCA1: physiological correlates in Brody disease.”, Acta Physiol Scand, 1998, pp. 55-67, Suppl 643.
Martin and Thornton, “Structural Families in Loops of Homologous Proteins: Automatic Classification, Modelling and Application to Antibodies.”, J Bmol Biol, 1996, pp. 800-815, vol. 263.
Morales et al., “Synthesis of beta(2)-microglobulin-free, disulphide-linked HLA-G5 homodimers in human placental villous cytotrophoblast cells.”, Immunology, 2007, pp. 179-188, vol. 122.
Mori et al., “Engineering Chinese Hamster Ovary Cells to Maximize Effector Function of Produced Antibodies Using FUT8 siRNA.”, Biotechnol Bioeng, 2004, pp. 901-908, vol. 88(7).
Myers, E. and Miller, W., “Optimal alignments in linear space.”, Comput Appl Biosci, 1988, pp. 11-17, vol. 4.
Needleman and Wunsch, “A General Method Applicable to the Search for Similarities in the Amino Acid Sequence of Two Proteins.”, J Mol Biol, 1970, pp. 444-453, vol. 48.
Olivier et al., “EB66 cell line, a duck embryonic stem cell-derived substrate for the industrial production of therapeutic monoclonal antibodies with enhanced ADCC activity.”, Mabs, 2010, pp. 405-415, vol. 2(4).
Osborn, et al., High-Affinity IgG Antibodies Develop Naturally in Ig-Knockout Rats Carrying Germline Human IgH/Igk/Igl Loci Bearing the Rat $C_H$Region, J. Immunol., Jan. 2013, pp. 1481-1490, vol. 190(4).
Padlan, E., “A Possible Procedure For Reducing The Immunogenicity of Antibody Variable Domains While Preserving Their Ligand-Binding Properties.”, Mol Immunol, 1991, pp. 489-499, vol. 28(4/5).
Sasaki et al., “Stucture-Mutation Analysis of the ATPase Site of Dictyostellium Discoideum Myosin II.”, Adv Biophys, 1998, pp. 1-24, vol. 35.
Schneider et al., “Characterization of EBV-genome negative “null” and “T” cell lines derived from children with acute lymphoblastic leukemia and leukemic transformed non-Hodgkin lymphoma.”, Int. J. Cancer, 1977, pp. 621-626, vol. 19(5).
Shi et al., “De Novo Selection of High-Affinity Antibodies from Synthetic Fab Libraries Displayed on Phage as pIX Fusion Proteins.”, J Mol Biol, 2010, pp. 385-396, vol. 397.
Shields et al., “Lack of Fucose on Human IgG1 N-Linked Oligosaccharide Improves Binding to Human FcRIII and Antibody-dependent Cellular Toxicity*.”, J Biol Chem, 2002, pp. 26733-26740, vol. 277(30).
Shinkawa et al., “The Absence of Fucose but Not the Presence of Galactose or Bisecting N-Acetylglucosamine of Human IgG1 Complex-type Oligosaccharides Shows the Critical Role of Enhancing Antibody-dependent Cellular Cytotoxicity*.”, J Biol Chem, 2003, pp. 3466-3473, vol. 278.
Singh et al., “Selective targeting of the IL23 pathway: Generation and characterization of a novel high-affinity humanized anti-IL23A antibody.”, Mabs, 2015, pp. 778-791 vol. 7(4).
Stickler et al., “The human G1m1 allotype associates with CD4+ T-cell responsiveness to a highly conserved IgG1 constant region peptide and confers an asparaginyl endopeptidase cleavage site.”, Genes and Immunity, 2011, pp. 213-221, vol. 12.
Väisänen et al., “Development of Sensitive Immunoassays for Free and Total Human Glandular Kallikrein 2.”, Clinical Chemistry, 2004, pp. 1607-1617, vol. 50(9).
Ward et al., “Binding activities of a repertoire of single immunoglobulin variable domains secreted from *Escherichia coil*.”, Nature, 1989, pp. 544-546, vol. 341.
Wilky, B. A., “Immune checkpoint inhibitors: The linchpins of modern immunotherapy.”, Immunol Rev, 2019, pp. 6-23, vol. 290.
Woyke et al., “In Vitro Activities and Postantifungal Effects of the Potent Dolastatin 10 Derivative Auristatin PHE.”, Antimicrob Agents and Chemother., Dec. 2001, pp. 3580-3584, vol. 45(12).
Wu and Kabat, “An Analysis of the Sequences of the Variable Regions of Bence Jones Proteins and Myeloma Light Chains And Their Implications for Anti-body Complementarity*.”, J Exp Med, 1970, pp. 211-250, vol. 132.
Wu, Z. & Cheung, N. V., “T cell engaging bispecific antibody (T-BsAb): From technology to therapeutics.”, Pharmacol Ther, 2018, pp. 161-175, vol. 182.
Zhang et al., “Functional optimization of agonistic antibodies to OX40 receptor with novel Fc mutations to promote antibody multimerization.”, Mabs, 2017, pp. 1129-1142, vol. 9.
Zhou et al., “Development of a simple and rapid method for producing non-fucosylated oligomannose containing antibodies with increased effector function.”, Biotechnol Bioeng, 2008, pp. 652-665, vol. 99.
Jonker et al., “Idiotype switching of CD4-specific monoclonal antibodies can prolong the therapeutic effectivenes in spite of host-anti-mouse IgG antibodies,” Eur. J. Immunol., vol. 17 (1987), pp. 1547-1553.
Brinkmann, Ulrich, and Roland E Kontermann. mAbs vol. 9,2 (2017): 182-212. doi: 0.1080/19420862.2016.1268307 (Year: 2017).
Buss, Nicholas APS, et al. Current opinion in pharmacology 12.5 (2012): 615-622 (Year: 2012).
Office Action (Non-Final Rejection) dated Jul. 16, 2024 for U.S. Appl. No. 18/180,225 (pp. 1-17).
Wang Xinhua et al. Protein & cell vol. 9,1 (2018): 63-73. doi: 10.1007/s13238-017-0473-8 (Year: 2018).

* cited by examiner

Figure 3.

```
CD3B815   DILLTQSPGILSVSPGERVSFSCRARQSIGTAIHWYQQRTNGSPRLLIKYASESISGIPSRF
CD3W244   DIQMTQSPSSLSASVGDRVTITCRARQSIGTAIHWYQQKPGKAPKLLIYYASESISGVPSRF
CD3W245   DIQMTQSPSSLSASVGDRVTITCRARQSIGTAIHWYQQKPGKAPKLLIKYASESISGVPSRF
CD3W246   DIQMTQSPSSLSASVGDRVTITCRARQSIGTAIHWYQQKPGKAPKLLIKYASESISGVPSRF
CD3W247   DIQMTQSPSSLSASVGDRVTITCRARQSIGTAIHWYQQKPGKAPKLLIYYASESISGVPSRF
CD3W248   DILLTQSPGILSVSPGERVSFSCRARQSIGTAIHWYQQRTNGSPRLLIKYASESISGIPSRF
          ***:****::**:*:*:**:::****************::::*:***:********:****

CD3B815   SGSGSGTDFTLTINSVESEDIADYYCQQSNSWPYTFGGGTKLEIK
CD3W244   SGSGSGTDFTLTISSVQPEDFATYYCQQSGSWPYTFGQGTKLEIK
CD3W245   SGSGSGTDFTLTISSLQPEDFATYYCQQSGSWPYTFGQGTKLEIK
CD3W246   SGSGSGTDFTLTISSVQPEDFATYYCQQSGSWPYTFGQGTKLEIK
CD3W247   SGSGSGTDFTLTISSLQPEDFATYYCQQSGSWPYTFGQGTKLEIK
CD3W248   SGSGSGTDFTLTINSVESEDIADYYCQQSGSWPYTFGGGTKLEIK
          ************:*:*:**:*:******:*******:*******
```

VL consensus sequence (SEQ ID NO: 103)

DIQX1TQSPX2X3LSX4SX5GX6RVX7X8X9CRARQSIGTAIHWYQQKX10X11X12X13PX14LLIX15YASESISGX16PSRFS GSGSGTDFTLTIX17SX18QX19EDX20AX21YYCQQSX22SWPYTFGX23GTKLEIK; wherein X1 is L or M;
X2 is G or S;
X3 is I or S;
X4 is V or A;
X5 is P or V;
X6 is E or D;
X7 is S or T;
X8 is F or I;
X9 is S or T
X10 is T or P;
X11 is N or G;
X12 is G or K;
X13 is S or A;
X14 is R or K;
X15 is K or Y;
X16 is I or V;
X17 is N or S;
X18 is V or L;
X19 is S or P;
X20 is I or F;
X21 is D or T;
X22 is N or G; or
X23 is G or Q.

Figure 4.

```
         10        20        30        40        50        60        70        80        90
          |         |         |         |         |         |         |         |         |
QDGNEEMGGITQTPYKVSISGTTVILTCPQYPGSEILWQHNDKNIGGDEDDKNIGSDEDHLSLKEFSELEQSGYYVCYPRGSKPEDANFYL  SEQ ID No:99 CD3ε
QDGNEEMGGITQTPYKVSISGTTVILTCPQYPGSEILWQHNDKNIGGDEDDKNIGSDEDHLSLKEFSELEQSGYYVCYPRGSKPEDANFYL  SEQ ID No:99 CD3ε:OKT3
QDGNEEMGGITQTPYKVSISGTTVILTCPQYPGSEILWQHNDKNIGGDEDDKNIGSDEDHLSLKEFSELEQSGYYVCYPRGSKPEDANFYL  SEQ ID No:99 CD3ε:CD3W245
```

Figure 5.

```
             1                                           45
mu11B6_VH    DVQLQESGPGLVKPSQSLSLTCTVTGNSITSDYAWNWIRQFPGNR
hu11B6_VH    QVQLQESGPGLVKPSDTLSLTCAVSGNSITSDYAWNWIRQPPGKG
KL2B357_VH   QVQLQESGPGLVKPSQTLSLTCTVSGNSITSDYAWNWIRQFPGKG
KL2B358_VH   QVQLQESGPGLVKPSQTLSLTCTVSGNSITSDYAWNWIRQPPGKG
KL2B359_VH   QVQLQESGPGLVKPSQTLSLTCTVSGNSITSDYAWNWIRQFPGKR
KL2B360_VH   QVQLQESGPGLVKPSQTLSLTCTVSGNSITSDYAWNWIRQFPGKG
      HCF3   QVQLQESGPGLVKPSDTLSLTCAVSGNSITSDYAWNWIRQFPGKG
      HCG5   QVQLQESGPGLVKPSDTLSLTCAVSGNSITSDYAWNWIRQFPGKG
       Aln   :**************::*****:*:*************** **:

             46                                          90
mu11B6_VH    LEWMGYISYSGSTTYSPSLKSRFSITRDTSKNQFFLQLNSVTPED
hu11B6_VH    LEWIGYISYSGSTTYNPSLKSRVTMSRDTSKNQFSLKLSSVTAVD
KL2B357_VH   LEWIGYISYSGSTTYNPSLKSRVTISRDTSKNQFSLKLSSVTAAD
KL2B358_VH   LEWIGYISYSGSTTYNPSLKSRVTISRDTSKNQFSLKLSSVTAAD
KL2B359_VH   LEWIGYISYSGSTTYNPSLKSRVTISRDTSKNQFSLKLSSVTAAD
KL2B360_VH   LEWIGYISYSGSTTYNPSLKSRVTISRDTSKNQFSLKLSSVTAAD
      HCF3   LEWIGYISYSGSTTYNPSLKSRVTISRDTSKNQFSLKLSSVTPVD
      HCG5   LEWMGYISYSGSTTYNPSLKSRVTISRDTSKNQFSLKLSSVTPVD
       Aln   ***:***********.******.:::******** *:*.***. *

             91                        117
mu11B6_VH    TATYFCATGYYYGSGFWGQGTLVTVSS
hu11B6_VH    TAVYYCATGYYYGSGFWGQGTLVTVSS
KL2B357_VH   TAVYYCATGYYYGSGFWGQGTLVTVSS
KL2B358_VH   TAVYYCATGYYYGSGFWGQGTLVTVSS
KL2B359_VH   TAVYYCATGYYYGSGFWGQGTLVTVSS
KL2B360_VH   TAVYYCATGYYYGSGFWGQGTLVTVSS
      HCF3   TAVYYCATGYYYGSGFWGQGTLVTVSS
      HCG5   TAVYYCATGYYYGSGFWGQGTLVTVSS
       Aln   **.*:**********************
```

VH consensus sequence (SEQ ID NO: 356)

QVQLQESGPGLVKPS$X_1$TLSLTC$X_2$VSGNSITSDYAWNWIRQ$X_3$PGK$X_4$LEW$X_5$GYISYSGSTT
YNPSLKSRVT$X_6$SRDTSKNQFSLKLSSVT$X_7X_8$DTAVYYCATGYYYGSGFWGQGTLVTVSS $X_1$ is D or Q;
$X_2$ is A or T;
$X_3$ is P or F;
$X_4$ is G or R;
$X_5$ is I or M;
$X_6$ is I or M;
$X_7$ is A or P; or
$X_8$ is V or A.

Figure 6.

```
             1                                                    55
mu11B6_VL    DIVLTQSPASLAVSLGQRATISCRASESVEYFGTSLMHWYRQKPGQPPKLLIYAA
hu11B6_VL    DIVLTQSPDSLAVSLGERATINCKASESVEYFGTSLMHWYQQKPGQPPKLLIYAA
KL2B357_VL   DIVLTQSPDSLAVSLGERATINCRASESVEYFGTSLMHWYQQKPGQPPKLLIYAA
KL2B358_VL   EIVLTQSPATLSLSPGERATLSCRASESVEYFGTSLMHWYQQKPGQPPRLLIYAA
KL2B359_VL   EIVLTQSPATLSLSPGERATLSCRASESVEYFGTSLMHWYQQKPGQPPRLLIYAA
KL2B360_VL   EIVLTQSPATLSLSPGERATLSCRASESVEYFGTSLMHWYQQKPGQPPRLLIYAA
      LCD6   DIVLTQSPDSLAVSLGERATINCKASESVEYFGTSLMHWYQQKPGQPPKLLIYAA
      LCB7   DIVLTQSPDSLAVSLGERATINCKASESVEYFGTSLMHWYQQKPGQPPKLLIYAA
       Aln   :******* :*::* *:***:.*:****************:*******:******

             56                                                    111
mu11B6_VL    SNVESGVPARFSGSGSGTDFSLNIQPVEEDDFSMYFCQQTRKVPYTFGGGTKLEIK
hu11B6_VL    SNRESGVPDRFSGSGSGTDFTLTISSLQAEDVAVYYCQQTRKVPYTFGQGTKLEIK
KL2B357_VL   SNVESGVPDRFSGSGSGTDFTLTISSLQAEDVAVYFCQQTRKVPYTFGGGTKVEIK
KL2B358_VL   SNVESGIPARFSGSGSGTDFTLTISSVEPEDFAVYFCQQTRKVPYTFGGGTKVEIK
KL2B359_VL   SNVESGIPARFSGSGSGTDFTLTISSVEPEDFAVYFCQQTRKVPYTFGGGTKVEIK
KL2B360_VL   SNVESGIPARFSGSGSGTDFTLTISSVEPEDFAVYFCQQTRKVPYTFGGGTKVEIK
      LCD6   SNRESGVPDRFSGSGSGTDFTLTIQSVQAEDVSVYFCQQTRKVPYTFGQGTKLEIK
      LCB7   SNRESGVPDRFSGSGSGTDFTLTISSVQAEDVAVYYCQQTRKVPYTFGQGTKLEIK
       Aln   ** ***:* ***********:*.*..:: :*.::*:************ ***:***
```

VL consensus sequence (SEQ ID NO: 357)

$X_1$IVLTQSP$X_2X_3$L$X_4X_5$S$X_6$GERAT$X_7X_8$C$X_9$ASESVEYFGTSLMHWYQQKPGQPP$X_{10}$LLIYAASN$X_{11}$ESG$X_{12}$P$X_{13}$RFSGSGSGTDFTLTI$X_{14}$S$X_{15}X_{16}$Q$X_{17}$ED$X_{18}X_{19}$VY$X_{20}$CQQTRKVPYTFG$X_{21}$GTK$X_{22}$EIK $X_1$ is D or E; $X_2$ is D or A; $X_3$ is S or T; $X_4$ is A or S; $X_5$ is V or L; $X_6$ is L or P; $X_7$ is I or L; $X_8$ is N or S; $X_9$ is R or K; $X_{10}$ is K or R; $X_{11}$ is V or R; $X_{12}$ is V or I; $X_{13}$ is A or D; $X_{14}$ is Q or S; $X_{15}$ is L or V; $X_{16}$ is Q or E; $X_{17}$ is P or A; $X_{18}$ is F or V; $X_{19}$ is A or S; $X_{20}$ is Y or F; $X_{21}$ is Q or G; and $X_{22}$ is L or V.

Figure 7.

```
            1                                                50
h11B6       VPLIEGRIVGGWECEKHSQPWQVAVYSHGWAHCGGVLVHPQWVLTAAHCL
KL2B494     VPLIEGRIVGGWECEKHSQPWQVAVYSHGWAHCGGVLVHPQWVLTAAHCL
KL2B467     VPLIEGRIVGGWECEKHSQPWQVAVYSHGWAHCGGVLVHPQWVLTAAHCL
KL2B30      VPLIEGRIVGGWECEKHSQPWQVAVYSHGWAHCGGVLVHPQWVLTAAHCL
KL2B413     VPLIEGRIVGGWECEKHSQPWQVAVYSHGWAHCGGVLVHPQWVLTAAHCL
KL2B53      VPLIEGRIVGGWECEKHSQPWQVAVYSHGWAHCGGVLVHPQWVLTAAHCL

            51                                              100
h11B6       KKNSQVWLGRHNLFEPEDTGQRVPVSHSFPHPLYNMSLLKHQSLRPDEDS
KL2B494     KKNSQVWLGRHNLFEPEDTGQRVPVSHSFPHPLYNMSLLKHQSLRPDEDS
KL2B467     KKNSQVWLGRHNLFEPEDTGQRVPVSHSFPHPLYNMSLLKHQSLRPDEDS
KL2B30      KKNSQVWLGRHNLFEPEDTGQRVPVSHSFPHPLYNMSLLKHQSLRPDEDS
KL2B413     KKNSQVWLGRHNLFEPEDTGQRVPVSHSFPHPLYNMSLLKHQSLRPDEDS
KL2B53      KKNSQVWLGRHNLFEPEDTGQRVPVSHSFPHPLYNMSLLKHQSLRPDEDS

            101                                             150
h11B6       SHDLMLLRLSEPAKITDVVKVLGLPTQEPALGTTCYASGWGSIEPEEFLR
KL2B494     SHDLMLLRLSEPAKITDVVKVLGLPTQEPALGTTCYASGWGSIEPEEFLR
KL2B467     SHDLMLLRLSEPAKITDVVKVLGLPTQEPALGTTCYASGWGSIEPEEFLR
KL2B30      SHDLMLLRLSEPAKITDVVKVLGLPTQEPALGTTCYASGWGSIEPEEFLR
KL2B413     SHDLMLLRLSEPAKITDVVKVLGLPTQEPALGTTCYASGWGSIEPEEFLR
KL2B53      SHDLMLLRLSEPAKITDVVKVLGLPTQEPALGTTCYASGWGSIEPEEFLR

            151                                             200
h11B6       PRSLQCVSLHLLSNDMCARAYSEKVTEFMLCAGLWTGGKDTCGGDSGGPL
KL2B494     PRSLQCVSLHLLSNDMCARAYSEKVTEFMLCAGLWTGGKDTCGGDSGGPL
KL2B467     PRSLQCVSLHLLSNDMCARAYSEKVTEFMLCAGLWTGGKDTCGGDSGGPL
KL2B30      PRSLQCVSLHLLSNDMCARAYSEKVTEFMLCAGLWTGGKDTCGGDSGGPL
KL2B413     PRSLQCVSLHLLSNDMCARAYSEKVTEFMLCAGLWTGGKDTCGGDSGGPL
KL2B53      PRSLQCVSLHLLSNDMCARAYSEKVTEFMLCAGLWTGGKDTCGGDSGGPL

            201                                     244
H11B6       VCNGVLQGITSWGPEPCALPEKPAVYTKVVHYRKWIKDTIAANP
KL2B494     VCNGVLQGITSWGPEPCALPEKPAVYTKVVHYRKWIKDTIAANP
KL2B467     VCNGVLQGITSWGPEPCALPEKPAVYTKVVHYRKWIKDTIAANP
KL2B30      VCNGVLQGITSWGPEPCALPEKPAVYTKVVHYRKWIKDTIAANP
KL2B413     VCNGVLQGITSWGPEPCALPEKPAVYTKVVHYRKWIKDTIAANP
KL2B53      VCNGVLQGITSWGPEPCALPEKPAVYTKVVHYRKWIKDTIAANP
```

Figure 11A.

Sequence of KL2B494 (Heavy Chain)

QVQLVESGGG LVQPGGSLRL SCAASGFTFS HYAMSWVRQA PGKGLEWVST
IGGSGGSTYY ADSVKGRFTI SRDNSKNTLY LQMNSLRAED TAVYYCAKPH
IVMVTALLYD GMDVWGQGTM VTVSSASTKG PSVFPLAPSS KSTSGGTAAL
GCLVKDYFPE PVTVSWNSGA LTSGVHTFPA VLQSSGLYSL SSVVTVPSSS
LGTQTYICNV NHKPSNTKVD KKVEPKSCDK THTCPPCPAP EAAGGPSVFL
FPPKPKDTLM ISRTPEVTCV VVSVSHEDPE VKFNWYVDGV EVHNAKTKPR
EEQYNSTYRV VSVLTVLHQD WLNGKEYKCK VSNKALPAPI EKTISKAKGQ
PREPQVYTLP PSREEMTKNQ VSLTCLVKGF YPSDIAVEWE SNGQPENNYK
TTPPVLDSDG SFFLYSKLTV DKSRWQQGNV FSCSVMHEAL HNHYTQKSLS
LSPGK

Sequence of KL2B494 (Light chain)

SSELTQPPSV SVAPGQTARI TCGGNNIGSK SVHWYQQKPG QAPVLVVYDD
SDRPSGIPER FSGSNSGNTA TLTISRVEAG DEADYYCQVW DSSSDHVVFG
GGTKLTVLGQ PKAAPSVTLF PPSSEELQAN KATLVCLISD FYPGAVTVAW
KADSSPVKAG VETTTPSKQS NNKYAASSYL SLTPEQWKSH RSYSCQVTHE
GSTVEKTVAP TECS

Figure 11B.

Sequence of KL2B467 (Heavy chain)

QVQLVESGGG VVQPGRSLRL SCAASGFTFS SYGMHWVRQA PGKGLEWVAF
ISYDGSNKYY ADSVKGRFTI SRDNSKNTLY LQMNSLRAED TAVYYCAHLP
YSGSYWAFDY WGQGTQVTVS SASTKGPSVF PLAPSSKSTS GGTAALGCLV
KDYFPEPVTV SWNSGALTSG VHTFPAVLQS SGLYSLSSVV TVPSSSLGTQ
TYICNVNHKP SNTKVDKKVE PKSCDKTHTC PPCPAPEAAG GPSVFLFPPK
PKDTLMISRT PEVTCVVVSV SHEDPEVKFN WYVDGVEVHN AKTKPREEQY
NSTYRVVSVL TVLHQDWLNG KEYKCKVSNK ALPAPIEKTI SKAKGQPREP
QVYTLPPSRE EMTKNQVSLT CLVKGFYPSD IAVEWESNGQ PENNYKTTPP
VLDSDGSFFL YSKLTVDKSR WQQGNVFSCS VMHEALHNHY TQKSLSLSPG
K

Sequence of KL2B467 (Light chain)

QSVLTQPPSV SVAPGQTASI TCGGDNIGSK SVHWYQQKPG QAPVLVVYDN
SDRPSGIPER FSGSNSGTTA TLTISRVEAG DEADYYCQVW DSSSDHPVVF
GGGTKVTVLG QPKAAPSVTL FPPSSEELQA NKATLVCLIS DFYPGAVTVA
WKADSSPVKA GVETTTPSKQ SNNKYAASSY LSLTPEQWKS HRSYSCQVTH
EGSTVEKTVA PTECS

Figure 11C.

Sequence of hu11B6 (Heavy chain)

QVQLQESGPG LVKPSDTLSL TCAVSGNSIT SDYAWNWIRQ PPGKGLEWIG
YISYSGSTTY NPSLKSRVTM SRDTSKNQFS LKLSSVTAVD TAVYYCATGY
YYGSGFWGQG TLVTVSSAST KGPSVFPLAP SSKSTSGGTA ALGCLVKDYF
PEPVTVSWNS GALTSGVHTF PAVLQSSGLY SLSSVVTVPS SSLGTQTYIC
NVNHKPSNTK VDKKVEPKSC DKTHTCPPCP APELLGGPSV FLFPPKPKDT
LMISRTPEVT CVVVDVSHED PEVKFNWYVD GVEVHNAKTK PREEQYNSTY
RVVSVLTVLH QDWLNGKEYK CKVSNKALPA PIEKTISKAK GQPREPQVYT
LPPSREEMTK NQVSLTCLVK GFYPSDIAVE WESNGQPENN YKTTPPVLDS
DGSFFLYSKL TVDKSRWQQG NVFSCSVMHE ALHNHYTQKS LSLSPGK

Sequence of hu11B6 (Light chain)

DIVLTQSPDS LAVSLGERAT INCKASESVE YFGTSLMHWY QQKPGQPPKL
LIYAASNRES GVPDRFSGSG SGTDFTLTIS SLQAEDVAVY YCQQTRKVPY
TFGQGTKLEI KRTVAAPSVF IFPPSDEQLK SGTASVVCLL NNFYPREAKV
QWKVDNALQS GNSQESVTEQ DSKDSTYSLS STLTLSKADY EKHKVYACEV
THQGLSSPVT KSFNRGEC

Figure 11D.

Sequence of KL2B413 (Heavy chain)

EVQLVESGGG LVQPGGSLRL SCAASGFTFS SYWMTWVRQP PGKGLEWVAN
IKQDGSERYF VDSVKGRFTI SRDNAKNSLY LQMNSLRAED TAVYYCARDQ
NYDILTGHYG MDVWGQGTTV TVSSASTKGP SVFPLAPCSR STSESTAALG
CLVKDYFPEP VTVSWNSGAL TSGVHTFPAV LQSSGLYSLS SVVTVPSSSL
GTKTYTCNVD HKPSNTKVDK RVESKYGPPC PPCPAPEAAG GPSVFLFPPK
PKDTLMISRT PEVTCVVVDV SQEDPEVQFN WYVDGVEVHN AKTKPREEQF
NSTYRVVSVL TVLHQDWLNG KEYKCKVSNK GLPSSIEKTI SKAKGQPREP
QVYTLPPSQE EMTKNQVSLT CLVKGFYPSD IAVEWESNGQ PENNYKTTPP
VLDSDGSFFL YSRLTVDKSR WQEGNVFSCS VMHEALHNHY TQKSLSLSLG
K

Sequence of KL2B413 (Light chain)

EIVLTQSPSF LSASVGDRVT ITCRASQGIS SYLSWYQQKP GKAPKLLIYA
TSTLQSGVPS RFSGSGSGTE FTLTISSLQP EDFATYYCQQ LNSYPRTFGQ
GTKVEIKRTV AAPSVFIFPP SDEQLKSGTA SVVCLLNNFY PREAKVQWKV
DNALQSGNSQ ESVTEQDSKD STYSLSSTLT LSKADYEKHK VYACEVTHQG
LSSPVTKSFN RGEC

Figure 11E.

Sequence of KL2B30 Fab of KLCB80 bispecific (heavy chain)

QVQLQESGPG LVKPSETLSL TCTVSGGSIS SYYWSWIRQP PGKGLEWIGY
IYYSGSTNYN PSLKSRVTIS VDTSKNQFSL KLSSVTAADT AVYYCAGTTI
FGVVIPNFYY GMDVWGQGTT VTVSSASTKG PSVFPLAPSS KSTSGGTAAL
GCLVKDYFPE PVTVSWNSGA LTSGVHTFPA VLQSSGLYSL SSVVTVPSSS
LGTQTYICNV NHKPSNTKVD KKVEPKSCDK THTCPPCPAP EAAGGPSVFL
FPPKPKDTLM ISRTPEVTCV VVSVSHEDPE VKFNWYVDGV EVHNAKTKPR
EEQYNSTYRV VSVLTVLHQD WLNGKEYKCK VSNKALPAPI EKTISKAKGQ
PREPQVYVLP PSREEMTKNQ VSLLCLVKGF YPSDIAVEWE SNGQPENNYL
TWPPVLDSDG SFFLYSKLTV DKSRWQQGNV FSCSVMHEAL HNHYTQKSLS
LSPG

Sequence of KL2B30 Fab of KLCB80 bispecific (light chain)

DIQMTQSPSF LSASVGDRVT ITCRASQGIS SYLAWYQQKP GKAPKFLIYA
ASTLQSGVPS RFSGSGSGTE FTLTISSLQP EDFATYYCQQ LNSYPLTFGG
GTKVEIKRTV AAPSVFIFPP SDEQLKSGTA SVVCLLNNFY PREAKVQWKV
DNALQSGNSQ ESVTEQDSKD STYSLSSTLT LSKADYEKHK VYACEVTHQG
LSSPVTKSFN RGEC

Figure 11F.

Sequence of KL2B353 Fab of KLCB113 bispecific (heavy chain)

EVQLVESGGG VVQPGRSLRL SCVASGFTFS SYDIHWVRQA PGKGLEWVAI
ISYDGSKKDY TDSVKGRFTI SRDNSKNTLY LQMDSLRVED SAVYSCARGS
GWSHYYYYGM DVWGQGTMVT VSSASTKGPS VFPLAPSSKS TSGGTAALGC
LVKDYFPEPV TVSWNSGALT SGVHTFPAVL QSSGLYSLSS VVTVPSSSLG
TQTYICNVNH KPSNTKVDKK VEPKSCDKTH TCPPCPAPEA AGGPSVFLFP
PKPKDTLMIS RTPEVTCVVV SVSHEDPEVK FNWYVDGVEV HNAKTKPREE
QYNSTYRVVS VLTVLHQDWL NGKEYKCKVS NKALPAPIEK TISKAKGQPR
EPQVYVLPPS REEMTKNQVS LLCLVKGFYP SDIAVEWESN GQPENNYLTW
PPVLDSDGSF FLYSKLTVDK SRWQQGNVFS CSVMHEALHN HYTQKSLSLS
PG

Sequence of KL2B353 Fab of KLCB113 bispecific (heavy chain)

DIVMTQSPSS LSASVGDRVT ITCRASQDIS NYLAWYQQKP GKVPKFLIYA
ASTLHSGVPS RFSGSGSGTD FTLTISSLQP EDVATYYCQK YNSAPYTFGQ
GTRLEIKRTV AAPSVFIFPP SDEQLKSGTA SVVCLLNNFY PREAKVQWKV
DNALQSGNSQ ESVTEQDSKD STYSLSSTLT LSKADYEKHK VYACEVTHQG
LSSPVTKSFN RGEC

PROTEINS COMPRISING CD3 ANTIGEN BINDING DOMAINS AND USES THEREOF

CROSS REFERENCE TO RELATED APPLICATIONS

This application claims priority to U.S. Provisional Application Ser. No. 63/030,448, filed May 27, 2020, Ser. No. 63/057,958, filed Jul. 29, 2020, and Ser. No. 63/094,931, filed Oct. 22, 2020. The disclosure of each of the aforementioned applications is incorporated herein by reference in its entirety.

SEQUENCE LISTING

The instant application contains a Sequence Listing which has been submitted electronically in ASCII format and is hereby incorporated by reference in its entirety. Said ASCII copy, created on May 11, 2021, is named JBI6316USNP1_SL.txt and is 1,061 bytes in size.

TECHNICAL FIELD

The disclosure provides antigen binding domains that bind cluster of differentiation 3 (CD3) protein comprising the antigen binding domains that bind CD3, polynucleotides encoding them, vectors, host cells, methods of making and using them.

BACKGROUND

Bispecific antibodies and antibody fragments have been explored as a means to recruit cytolytic T cells to kill tumor cells. However, the clinical use of many T cell-recruiting bispecific antibodies has been limited by challenges including unfavorable toxicity, potential immunogenicity, and manufacturing issues. There thus exists a considerable need for improved bispecific antibodies that recruit cytolytic T cells to kill tumor cells that include, for example, reduced toxicity and favorable manufacturing profiles.

The human CD3 T cell antigen receptor protein complex is composed of six distinct chains: a CD3γ chain (SwissProt P09693), a CD3δ chain (SwissProt P04234), two CD3ε chains (SwissProt P07766), and one CD3ζ chain homodimer (SwissProt P20963) (ε γ: ε δ:ζ), which is associated with the T cell receptor α and β chain. This complex plays an important role in coupling antigen recognition to several intracellular signal-transduction pathways. The CD3 complex mediates signal transduction, resulting in T cell activation and proliferation. CD3 is required for immune response.

Redirection of cytotoxic T cells to kill tumor cells has become an important therapeutic mechanism for numerous oncologic indications (Labrijn, A. F., Janmaat, M. L., Reichert, J. M. & Parren, P. Bispecific antibodies: a mechanistic review of the pipeline. Nat Rev Drug Discov 18, 585-608, doi:10.1038/s41573-019-0028-1 (2019)). T cell activation follows a two-signal hypothesis, in which the first signal is supplied by engagement of the T cell receptor (TCR) complex with its cognate peptide MHC complex on an antigen presenting cell (APC), and the second signal may be either co-stimulatory or co-inhibitory (Chen, L. & Flies, D. B. Molecular mechanisms of T cell co-stimulation and co-inhibition. Nat Rev Immunol 13, 227-242, doi: 10.1038/nri3405 (2013)). Tumors often fail to present sufficient non-self antigens to induce a T cell-based immune response, and T cell-engaging BsAbs (bsTCE) can overcome this challenge by inducing T cell activation in the absence of TCR-pMHC interaction. T cell receptor signaling occurs through the ITAM motifs in the cytoplasmic region of the CD3 subunits of the TCR (Chen, D. S. & Mellman, I. Oncology meets immunology: the cancer-immunity cycle. Immunity 39, 1-10, doi:10.1016/j.immuni.2013.07.012 (2013)). In particular, the CD3ε subunit is present in two copies per TCR complex and represents an attractive antigen for T cell engagement. Indeed, numerous bsTCE that target CD3ε have shown clinical anti-tumor efficacy where mAbs have failed, and significant pharmaceutical development efforts are ongoing for several tumor targets (Labrijn, A. F. et al., 2019). Three major challenges for clinical development of bsTCE are 1) the potential for rapid and severe toxicity associated with cytokine release via systemic or off-tumor T cell activation, 2) practical challenges of formulation and dosing for bsTCE with high potency and sharp therapeutic indices, and 3) the potential for reactivation-induced T cell death, wherein tumor-infiltrating T cells (TILS) undergo apoptosis in response to over-activation by bsTCE (Wu, Z. & Cheung, N. V. T cell engaging bispecific antibody (T-BsAb): From technology to therapeutics. Pharmacol Ther 182, 161-175, doi:10.1016/j.pharmthera.2017.08.005 (2018)).

Together, these observations suggest that there is a need in the art for novel CD3 specific binding proteins that are more advantageous and can be used to treat cancers.

SUMMARY

The disclosure satisfies this need, for example, by providing novel CD3ε specific binding proteins that possess high affinity for the tumor antigen and weak affinity for the T cell. The proteins comprising an antigen binding domain that binds CD3ε of the disclosure demonstrated high thermostability, reduced deamidation risk, and decreased immunogenicity.

In certain embodiments, the disclosure provides an isolated protein comprising an antigen binding domain that binds to cluster of differentiation 3ε (CD3ε), wherein the antigen binding domain that binds CD3ε comprises:

a. a heavy chain complementarity determining region (HCDR) 1, a HCDR2 and a HCDR3 of a heavy chain variable region (VH) of SEQ ID NO: 23 and a light chain complementarity determining region (LCDR) 1, a LCDR2 and a LCDR3 of a light chain variable region (VL) of SEQ ID NO: 24;
b. the HCDR1, the HCDR2 and the HCDR3 of the VH of SEQ ID NO: 23 and the LCDR1, the LCDR2 and the LCDR3 of the VL of SEQ ID NO: 27;
c. the HCDR1, the HCDR2 and the HCDR3 of the VH of SEQ ID NO: 23 and the LCDR1, the LCDR2 and the LCDR3 of the VL of SEQ ID NO: 28;
d. the HCDR1, the HCDR2 and the HCDR3 of the VH of SEQ ID NO: 23 and the LCDR1, the LCDR2 and the LCDR3 of the VL of SEQ ID NO: 29; or
e. the HCDR1, the HCDR2 and the HCDR3 of the VH of SEQ ID NO: 23 and the LCDR1, the LCDR2 and the LCDR3 of the VL of SEQ ID NO: 30.

In other embodiments, the isolated protein comprises the HCDR1, the HCDR2, the HCDR3, the LCDR1, the LCDR2 and the LCDR3 of a. SEQ ID NOs: 6, 7, 8, 9, 10, and 11, respectively;
b. SEQ ID NOs:12, 13, 14, 15, 16, and 17, respectively; or
c. SEQ ID NOs: 18, 19, 20, 21, 16, and 22, respectively.

In other embodiments, the antigen binding domain that binds CD3ε is a scFv, a (scFv)2, a Fv, a Fab, a F(ab')2, a Fd, a dAb or a VHH.

In other embodiments, the antigen binding domain that binds CD3ε is the Fab.

In other embodiments, the antigen binding domain that binds CD3ε is the VHH.

In other embodiments, the antigen binding domain that binds CD3ε is the scFv.

In other embodiments, the scFv comprises, from the N- to C-terminus, a VH, a first linker (L1) and a VL (VH-L1-VL) or the VL, the L1 and the VH (VL-L1-VH).

In certain embodiments, the L1 comprises a. about 5-50 amino acids;
b. about 5-40 amino acids;
c. about 10-30 amino acids; or
d. about 10-20 amino acids.

In certain embodiments, the L1 comprises an amino acid sequence of SEQ ID NOs: 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, or 64.

In certain embodiments, the L1 comprises the amino acid sequence of SEQ ID NO: 31, 37, or 64.

In other embodiments, the antigen binding domain that binds CD3ε comprises the VH of SEQ ID NOs: 23 and the VL of SEQ ID NOs: 24, 27, 28, 29 or 30.

In other embodiments, the antigen binding domain that binds CD3ε comprises:

a. the VH of SEQ ID NO: 23 and the VL of SEQ ID NO: 24;
b. the VH of SEQ ID NO: 23 and the VL of SEQ ID NO: 27;
c. the VH of SEQ ID NO: 23 and the VL of SEQ ID NO: 28;
d. the VH of SEQ ID NO: 23 and the VL of SEQ ID NO: 29; or
e. the VH of SEQ ID NO: 23 and the VL of SEQ ID NO: 30.

In other embodiments, the antigen binding domain that binds CD3ε comprises the amino acid sequence of SEQ ID NOs: 65, 66, 67, 68, 69, 70, 71, 72, 73, or 74.

The disclosure provides an isolated protein comprising an antigen binding domain that binds CD3ε, wherein the antigen binding domain that binds CD3ε comprises a heavy chain variable region (VH) of SEQ ID NO: 23 and a light chain variable region (VL) of SEQ ID NO: 103. In other embodiments, the antigen binding domain that binds CD3ε is a scFv, a (scFv)2, a Fv, a Fab, a F(ab')2, a Fd, a dAb or a VHH. In other embodiments, the scFv comprises, from the N- to C-terminus, a VH, a first linker (L1) and a VL (VH-L1-VL) or the VL, the L1 and the VH (VL-L1-VH). In other embodiments, the L1 comprises a. about 5-50 amino acids; b. about 5-40 amino acids; c. about 10-30 amino acids; or d. about 10-20 amino acids. In other embodiments, the L1 comprises an amino acid sequence of SEQ ID NOs: 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, or 64. In other embodiments, the antigen binding domain that binds CD3ε comprises the VH of SEQ ID NO: 23 and the VL of SEQ ID NO: 24, 27, 28, 29, or 30. In various embodiments, the antigen binding domain that binds CD3ε comprises: the VH of SEQ ID NO: 23 and the VL of SEQ ID NO: 24; the VH of SEQ ID NO: 23 and the VL of SEQ ID NO: 27; the VH of SEQ ID NO: 23 and the VL of SEQ ID NO: 28; the VH of SEQ ID NO: 23 and the VL of SEQ ID NO: 29; or the VH of SEQ ID NO: 23 and the VL of SEQ ID NO: 30.

In other embodiments, the isolated protein is a monospecific protein. In other embodiments, the isolated protein is a multispecific protein. In other embodiments, the multispecific protein is a bispecific protein. In other embodiments, the multispecific protein is a trispecific protein.

In other embodiments, the protein is conjugated to a half-life extending moiety.

In other embodiments, the half-life extending moiety is an immunoglobulin (Ig), a fragment of the Ig, an Ig constant region, a fragment of the Ig constant region, a Fc region, transferrin, albumin, an albumin binding domain or polyethylene glycol.

In other embodiments, the isolated protein further comprises an immunoglobulin (Ig) constant region or a fragment of the Ig constant region thereof.

In other embodiments, the fragment of the Ig constant region comprises a Fc region.

In other embodiments, the fragment of the Ig constant region comprises a CH2 domain.

In other embodiments, the fragment of the Ig constant region comprises a CH3 domain.

In other embodiments, the fragment of the Ig constant region comprises the CH2 domain and the CH3 domain.

In other embodiments, the fragment of the Ig constant region comprises at least portion of a hinge, the CH2 domain and the CH3 domain.

In other embodiments, the fragment of the Ig constant region comprises a hinge, the CH2 domain and the CH3 domain.

In other embodiments, the antigen binding domain that binds CD3ε is conjugated to the N-terminus of the Ig constant region or the fragment of the Ig constant region.

In other embodiments, the antigen binding domain that binds CD3ε is conjugated to the C-terminus of the Ig constant region or the fragment of the Ig constant region.

In other embodiments, the antigen binding domain that binds CD3ε is conjugated to the Ig constant region or the fragment of the Ig constant region via a second linker (L2).

In other embodiments, the L2 comprises the amino acid sequence of SEQ ID NOs: 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, or 64.

In other embodiments, the multispecific protein comprises an antigen binding domain that binds an antigen other than CD3ε.

In other embodiments, the cell antigen is a tumor associated antigen. In other embodiments, the tumor associated antigen is kallikrein related peptidase 2 (hK2) protein. In other embodiments, the tumor associated antigen is human leukocyte antigen G (HLA-G). In other embodiments, the tumor associated antigen is prostate-specific membrane antigen (PSMA). In other embodiments, the tumor associated antigen is delta-like protein 3 (DLL3). In other embodiments, the Ig constant region or the fragment of the Ig constant region is an IgG1, an IgG2, an IgG3 or an IgG4 isotype.

In other embodiments, the Ig constant region or the fragment of the Ig constant region comprises at least one mutation that results in reduced binding of the protein to a Fcγ receptor (FcγR). In other embodiments, the at least one mutation that results in reduced binding of the protein to the FcγR is selected from the group consisting of F234A/L235A, L234A/L235A, L234A/L235A/D265S, V234A/G237A/P238S/H268A/V309L/A330S/P331S, F234A/L235A, S228P/F234A/L235A, N297A, V234A/G237A, K214T/E233P/L234V/L235A/G236-deleted/A327G/P331A/D365E/L358M, H268Q/V309L/A330S/P331S, S267E/L328F, L234F/L235E/D265A, L234A/L235A/G237A/P238S/H268A/A330S/P331S, S228P/F234A/L235A/G237A/P238S and S228P/F234A/L235A/G236-deleted/G237A/P238S, wherein residue numbering is according to the EU index.

In other embodiments, the Ig constant region or the fragment of the Ig constant region comprises at least one mutation that results in enhanced binding of the protein to the FcγR.

In other embodiments, the at least one mutation that results in enhanced binding of the protein to the FcγR is selected from the group consisting of S239D/I332E, S298A/E333A/K334A, F243L/R292P/Y300L, F243L/R292P/Y300L/P396L, F243L/R292P/Y300L/V305I/P396L and G236A/S239D/I332E, wherein residue numbering is according to the EU index.

In other embodiments, the FcγR is FcγRI, FcγRIIA, FcγRIIB or FcγRIII, or any combination thereof.

In other embodiments, the Ig constant region or the fragment of the Ig constant region comprises at least one mutation that modulates a half-life of the protein.

In other embodiments, the at least one mutation that modulates the half-life of the protein is selected from the group consisting of H435A, P257I/N434H, D376V/N434H, M252Y/S254T/T256E/H433K/N434F, T308P/N434A and H435R, wherein residue numbering is according to the EU index.

In other embodiments, the protein comprises at least one mutation in a CH3 domain of the Ig constant region.

In other embodiments, the at least one mutation in the CH3 domain of the Ig constant region is selected from the group consisting of T350V, L351Y, F405A, Y407V, T366Y, T366W, T366L, F405W, K392L, T394W, T394S, Y407T, Y407A, T366S/L368A/Y407V, L351Y/F405A/Y407V, T366I/K392M/T394W, T366L/K392L/T394W, F405A/Y407V, T366L/K392M/T394W, L351Y/Y407A, T366A/K409F, L351Y/Y407A, L351Y/Y407V, T366V/K409F, T366A/K409F, T350V/L351Y/F405A/Y407V and T350V/T366L/K392L/T394W, wherein residue numbering is according to the EU index.

The disclosure also provides a pharmaceutical composition comprising the isolated protein comprising the antigen binding domain that binds to CD3ε of the disclosure and a pharmaceutically acceptable carrier.

The disclosure also provides a polynucleotide encoding the protein comprising the antigen binding domain that binds to CD3ε of the disclosure.

The disclosure also provides a vector comprising the polynucleotide encoding the protein comprising the antigen binding domain that binds to CD3ε of the disclosure.

The disclosure also provides a host cell comprising the vector comprising the polynucleotide encoding the protein comprising the antigen binding domain that binds to CD3ε of the disclosure.

The disclosure also provides a method of producing the isolated protein of the disclosure, comprising culturing the host cell of the disclosure in conditions that the protein is expressed, and recovering the protein produced by the host cell.

The disclosure also provides a method of treating a cancer in a subject, comprising administering a therapeutically effective amount of the compositions comprising the isolated antibody comprising the antigen binding domain that binds to CD3ε to the subject in need thereof to treat the cancer. In other embodiments, the cancer is a solid tumor or a hematological malignancy. In other embodiments, the solid tumor is a prostate cancer, a colorectal cancer, a gastric cancer, a clear cell renal carcinoma, a bladder cancer, a lung cancer, a squamous cell carcinoma, a glioma, a breast cancer, a kidney cancer, a neovascular disorder, a clear cell renal carcinoma (CCRCC), a pancreatic cancer, a renal cancer, a urothelial cancer or an adenocarcinoma to the liver. In other embodiments, the hematological malignancy is acute myeloid leukemia (AML), myelodysplastic syndrome (MDS), acute lymphocytic leukemia (ALL), diffuse large B-cell lymphoma (DLBCL), chronic myeloid leukemia (CML) or blastic plasmacytoid dendritic cell neoplasm (DPDCN). In other embodiments, the antibody is administered in combination with a second therapeutic agent.

The disclosure also provides an anti-idiotypic antibody binding to the isolated protein comprising the antigen binding domain that binds to CD3ε of the disclosure.

The disclosure also provides an isolated protein comprising an antigen binding domain that binds to an epitope on CD3ε (SEQ ID NO: 1), wherein the epitope is a discontinuous epitope comprising the amino acid sequences of SEQ ID NO: 100, 101, and 102.

The disclosure also provides an isolated protein comprising an amino acid sequence selected from the group consisting of SEQ ID NOs: 747, 748, 77, 78, 749, 750, 751, 752, 753, and 754.

In one embodiment, the disclosure provides an isolated protein comprising amino acid sequences of SEQ ID NO: 747. In one embodiment, the disclosure provides an isolated protein comprising amino acid sequences of SEQ ID NO: 748. In one embodiment, the disclosure provides an isolated protein comprising amino acid sequences of SEQ ID NO: 77. In one embodiment, the disclosure provides an isolated protein comprising amino acid sequences of SEQ ID NO: 78. In one embodiment, the disclosure provides an isolated protein comprising amino acid sequences of SEQ ID NO: 749. In one embodiment, the disclosure provides an isolated protein comprising amino acid sequences of SEQ ID NO: 750. In one embodiment, the disclosure provides an isolated protein comprising amino acid sequences of SEQ ID NO: 751. In one embodiment, the disclosure provides an isolated protein comprising amino acid sequences of SEQ ID NO: 752. In one embodiment, the disclosure provides an isolated protein comprising amino acid sequences of SEQ ID NO: 753. In one embodiment, the disclosure provides an isolated protein comprising amino acid sequences of SEQ ID NO: 754.

The disclosure also provides an isolated protein comprising amino acid sequences of SEQ ID NOs: 85 and 86.

The disclosure also provides an isolated protein comprising amino acid sequences of SEQ ID NOs: 85 and 88.

The disclosure also provides an isolated protein comprising amino acid sequences of SEQ ID NOs: 85 and 90.

The disclosure also provides an isolated protein comprising amino acid sequences of SEQ ID NOs: 85 and 92.

The disclosure also provides an isolated protein comprising amino acid sequences of SEQ ID NOs: 85 and 94.

BRIEF DESCRIPTIONS OF THE DRAWINGS

The summary, as well as the following detailed description, is further understood when read in conjunction with the appended drawings. For the purpose of illustrating the disclosed antibodies and methods, there are shown in the drawings exemplary embodiments of the antibodies and methods; however, antibodies and methods are not limited to the specific embodiments disclosed. In the drawings:

FIG. 3 shows the alignment of the VL regions of CD3B815 (SEQ ID NO: 119), CD3W244 (SEQ ID NO: 27), CD3W245 (SEQ ID NO: 28), CD3W246 (SEQ ID NO: 24), CD3W247 (SEQ ID NO: 29) and CD3W248 (SEQ ID NO: 30).

FIG. 4 shows hydrogen-deuterium exchange rates determined using hydrogen-deuterium exchange mass spectrometry (HDX-MS) measured for the complex of CD3W245 bound to CD3ε (CD3ε: CD3W245), or the complex of OKT3 bound to human CD3ε (CD3ε:OKT3) (SEQ ID NO: 99 which is a fragment of SEQ ID NO: 5 is shown). Single underline indicates segments with 10%-30% decrease in deuteration levels and double underline indicates segments with >30% decrease in deuteration levels in the presence of the antibody, as compared to CD3ε alone.

FIG. 5 shows the sequence alignment of the VH domains of mu11B6, hu11B6, KL2B357, KL2B358, KL2B359, KL2B360, HCF3 and HCG5. FIG. 5 discloses SEQ ID NOS 126, 124, 132, 134, 136, 132, 128 and 130, respectively, in order of appearance.

FIG. 6 shows the sequence alignment of the VL domains of mu11B6, hu11B6, KL2B357, KL2B358, KL2B359, KL2B360, LDC6 and LCB7. FIG. 6 discloses SEQ ID NOs: 127, 125, 133, 135, 135, 135, 129 and 131, respectively, in order of appearance.

FIG. 7 shows the binding epitopes of selected hK2 antibodies mapped onto the sequence of hK2 antigen. FIG. 7 discloses SEQ ID NO: 745, 741, 741, 741, 741 and 741, respectively, in order of appearance.

Figure 8A:
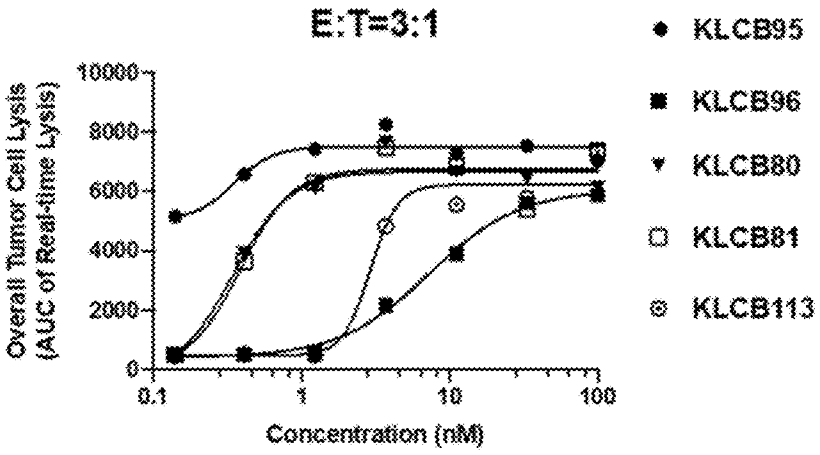

FIG. 8A shows in vitro target cytotoxicity of KL2B×CD3 bi-specific molecules measured by incuCyte imaging system in real-time for quantifying target cell death.

Figure 8B:
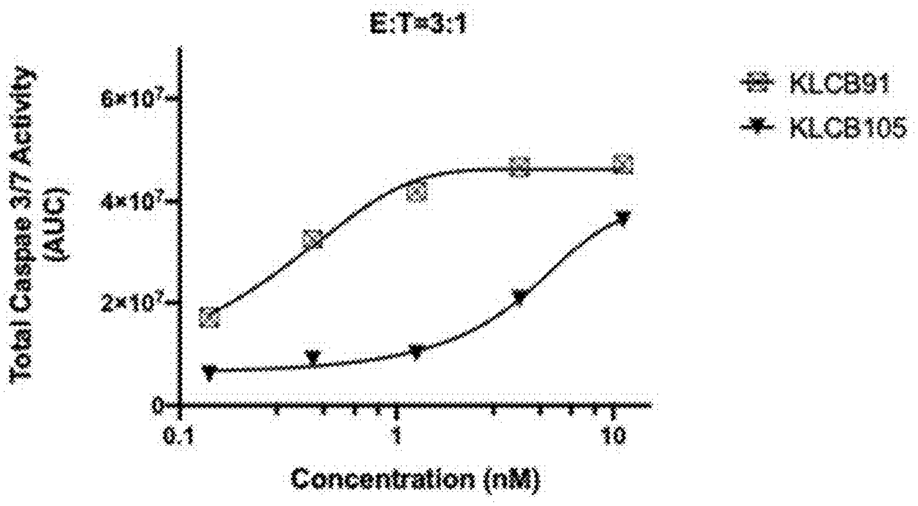

FIG. 8B shows in vitro target cytotoxicity of KL2B×CD3 bi-specific molecules measured by fluorescent caspase 3/7 reagent to measure apoptosis signal from target cell death.

Figure 9A:
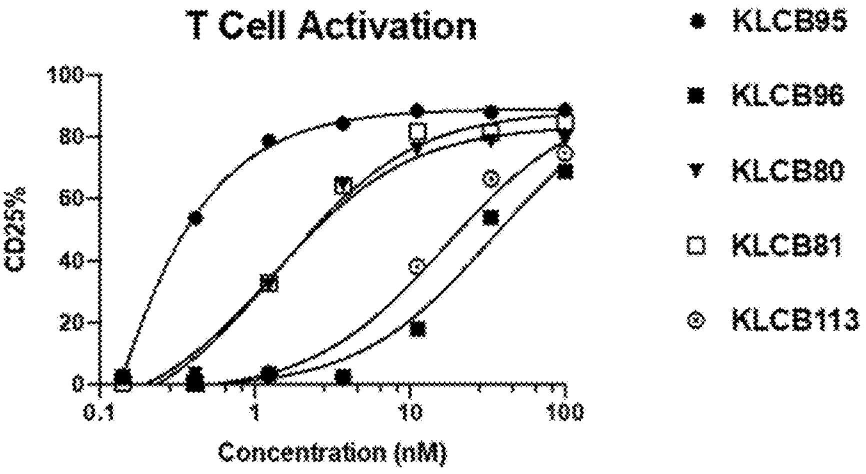

FIG. 9A shows in vitro T cell activation and proliferation by KLK2×CD3 bi-specific antibodies by showing the frequency of CD25 positive cells at different doses.

Figure 9B:
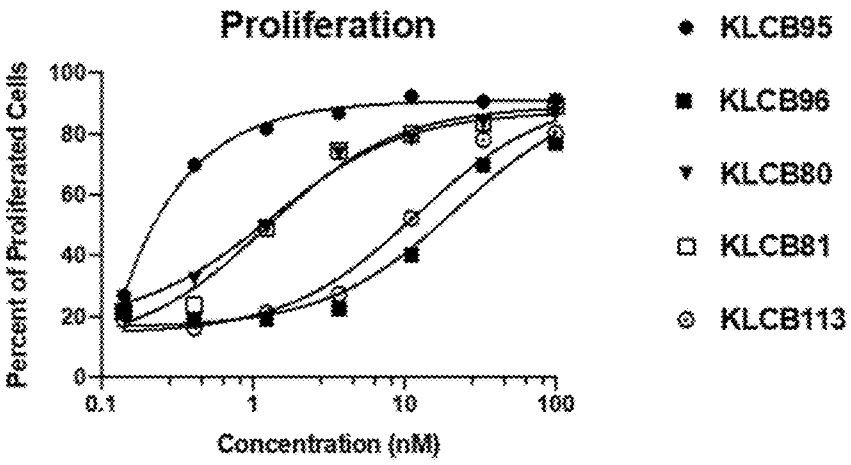

FIG. 9B shows in vitro T cell activation and proliferation by KLK2×CD3 bi-specific antibodies by showing the frequency of cells entering into proliferation gate.

Figure 10A:
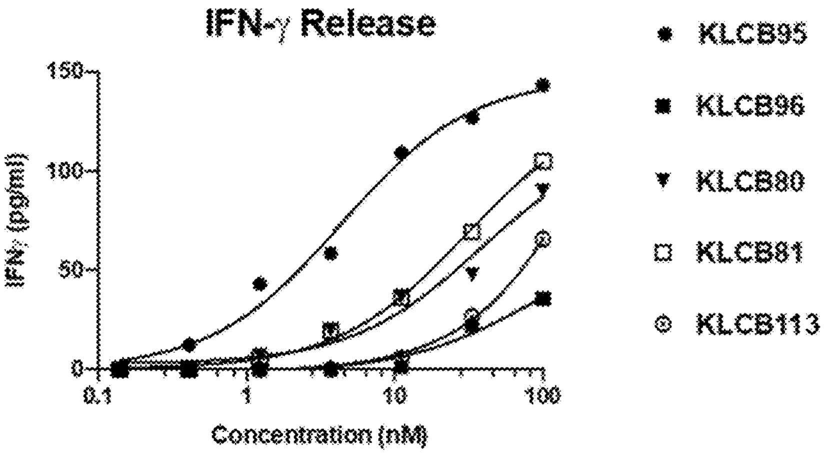

FIG. 10A shows in vitro T cell INF-γ release by KLK2×CD3 bi-specific antibodies.

Figure 10B:
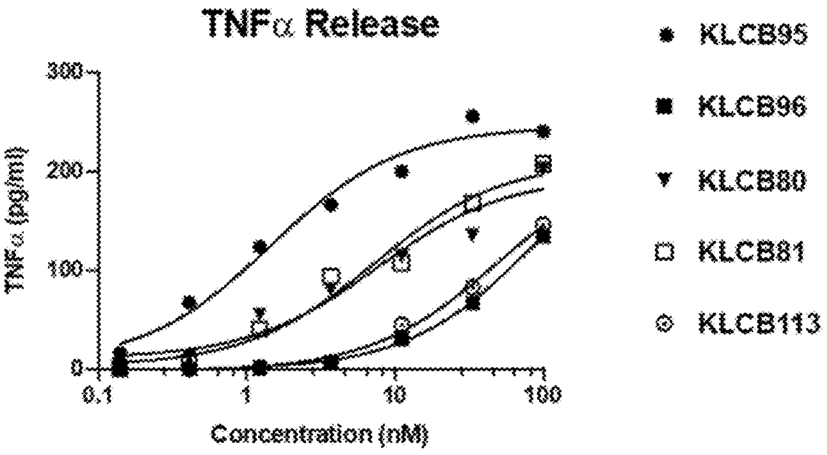

FIG. 10B shows in vitro T cell TNF-α release by KLK2×CD3 bi-specific antibodies.

FIG. 11 (11A-11F) shows the binding paratope of selected anti-hK2 antibodies and selected anti-hK2/CD3 bispecific antibodies. Underlined sequences indicate CDR regions and highlighted sequences indicate paratope regions. FIG. 11A discloses SEQ ID NOs: 219-220, respectively, in order of appearance. FIG. 11B discloses SEQ ID NOs: 213 and 224, respectively, in order of appearance. FIG. 11C discloses SEQ ID NOs: 208 and 215, respectively, in order of appearance. FIG. 11D discloses SEQ ID NOs: 742 and 743, respectively, in order of appearance. FIG. 11E discloses SEQ ID NOs: 327 and 221, respectively, in order of appearance. FIG. 11F discloses SEQ ID NOs: 329 and 222, respectively, in order of appearance.

Figure 12:
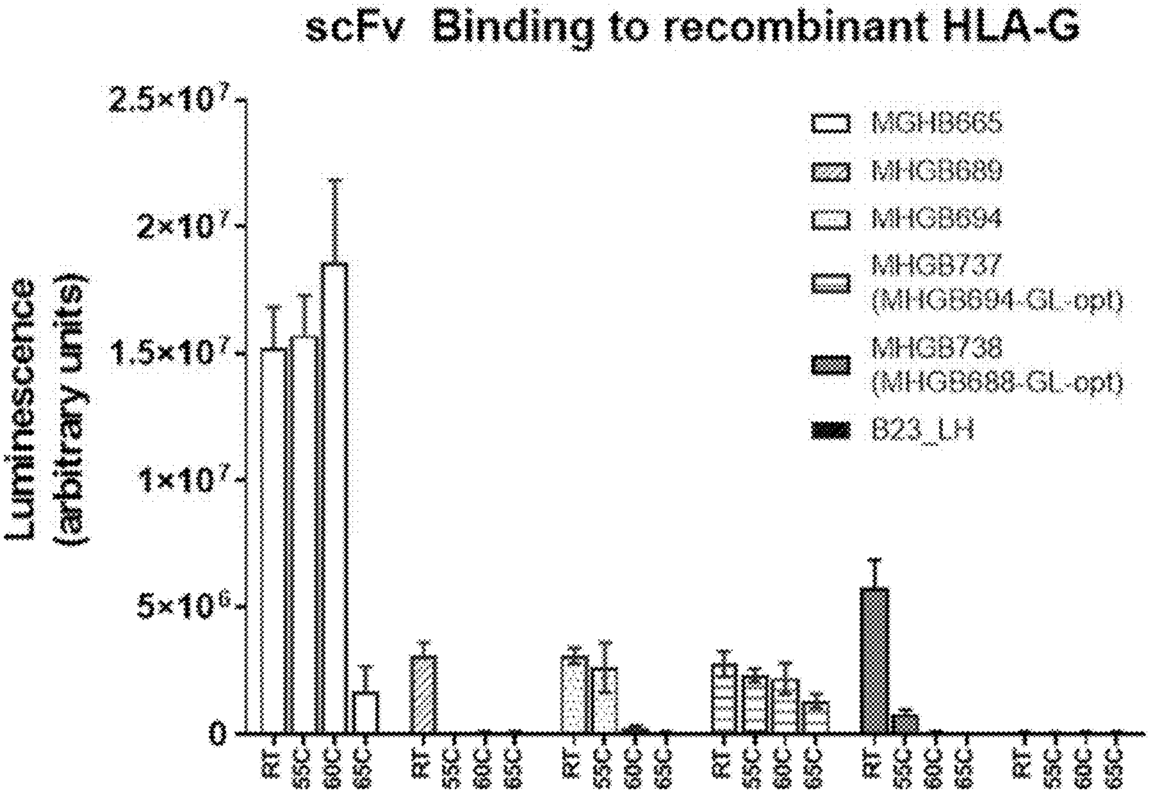

FIG. 12 shows the ability of v-regions to bind recombinant HLA-G after heat treatment when formatted as scFv.

Figure 13:
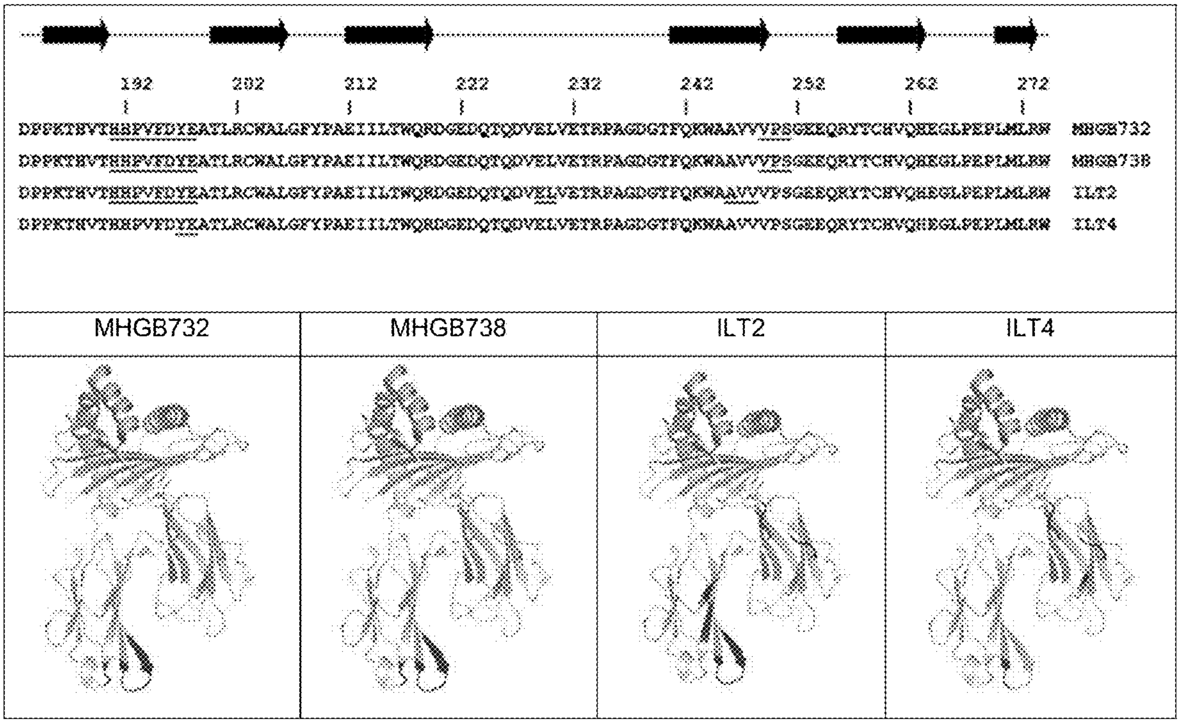

FIG. 13 shows the epitope mapping of select antibodies on HLA-G (SEQ ID NO: 691) using the hydrogen-deuterium exchange-based LC-MS. The sequence shown is the fragment of SEQ ID NO: 691, with the amino acid residue numbering starting from the first residue of the mature HLA-G (residues 183-274 are shown). FIG. 13 discloses SEQ ID NO: 746, 746, 744 and 744, respectively, in order of appearance.

Figure 14A:
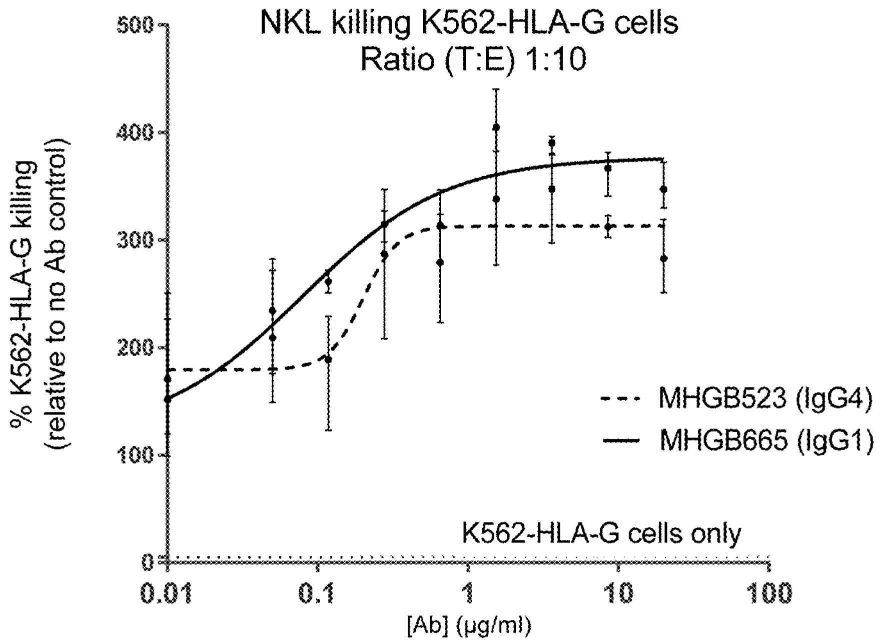
Figure 14B:
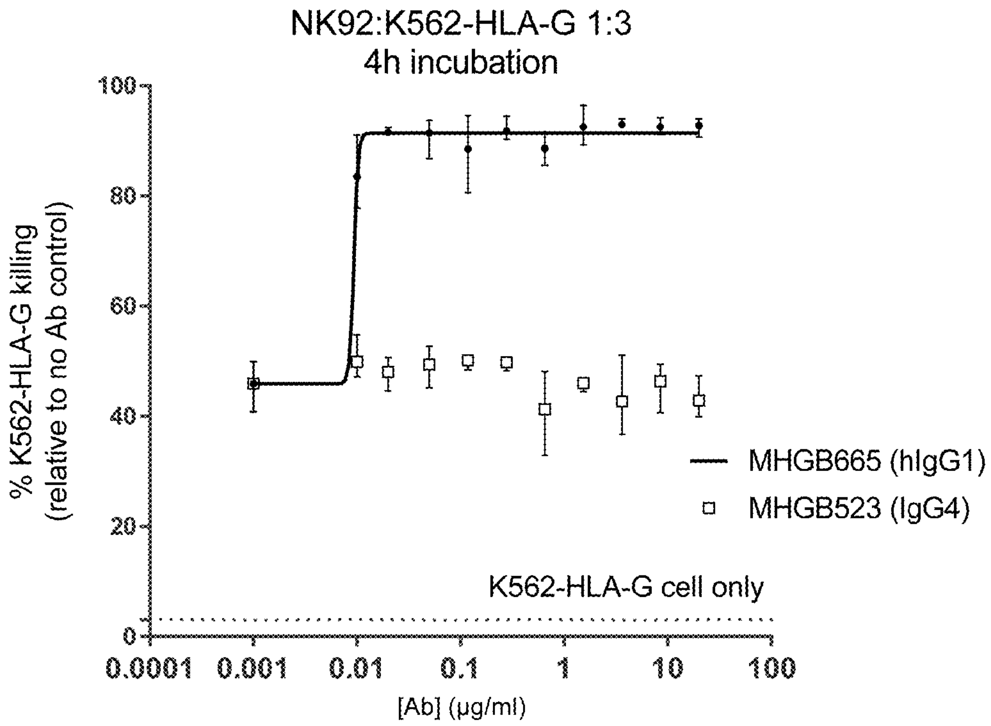

FIGS. 14A-14B show the enhancement of NK cell-mediated cytotoxicity of K562-HLA-G cells by the MHGB665-derived variable region engineered on either IgG1 (MHGB665) or IgG4 (MHGB523). FIG. 14A shows NKL cell-mediated cytotoxicity; FIG. 14B shows NK-92 cell-mediated cytotoxicity.

Figure 15A:
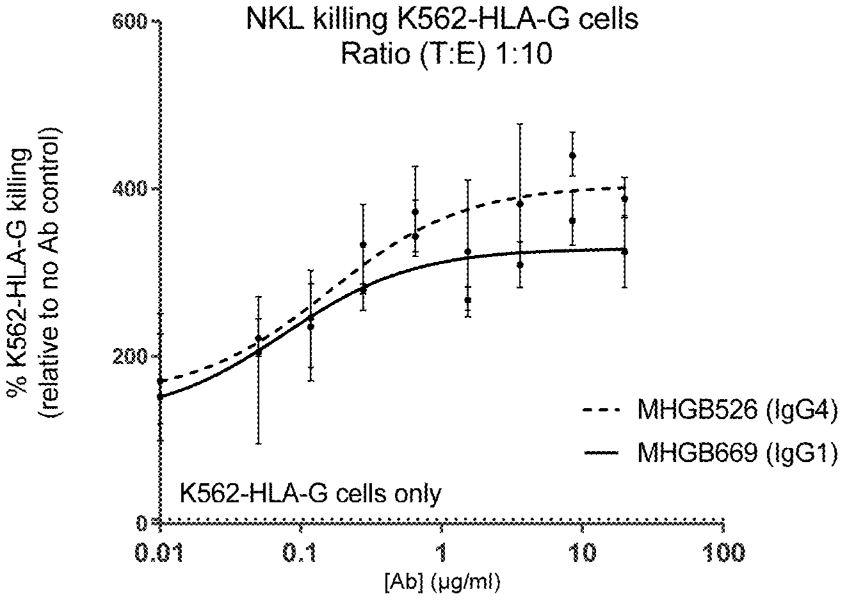
Figure 15B:
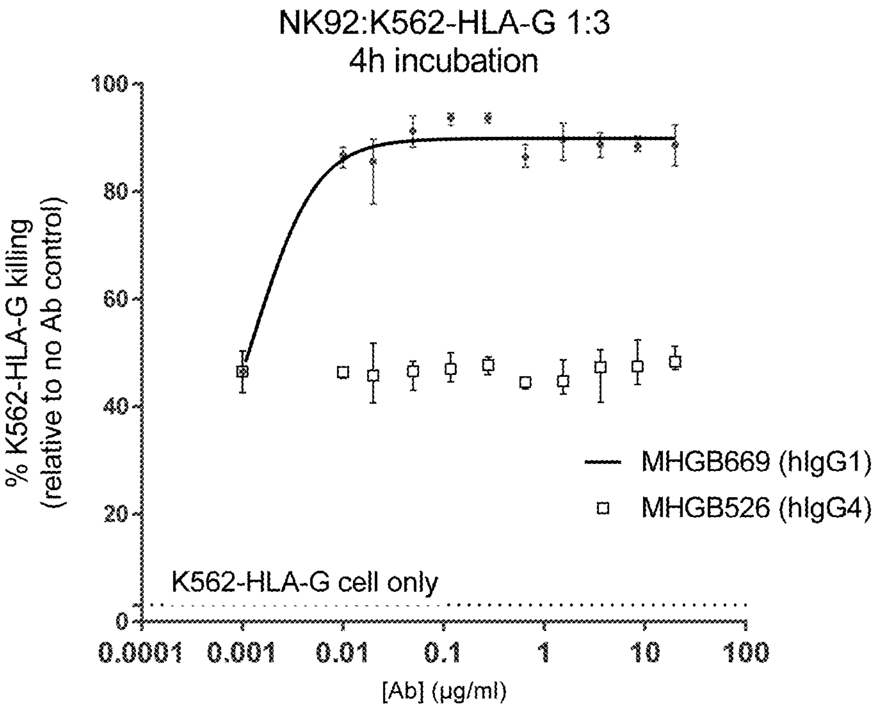

FIGS. 15A-15B show the enhancement of NK cell-mediated cytotoxicity of K562-HLA-G cells by the MHGB669-derived variable region engineered on either IgG1 (MHGB669) or IgG4 (MHGB526). FIG. 15A shows NKL cell-mediated cytotoxicity; FIG. 15B shows NK-92 cell-mediated cytotoxicity.

Figure 16A:
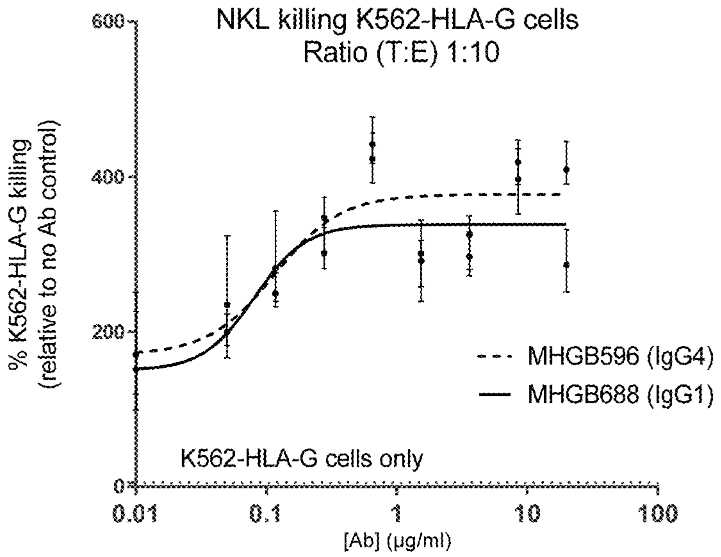
Figure 16B:
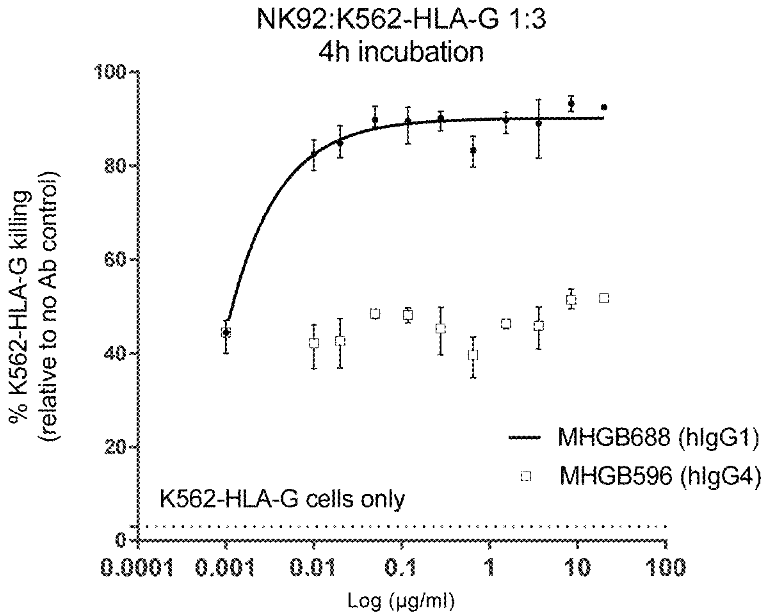

FIGS. 16A-16B show the enhancement of NK cell-mediated cytotoxicity of K562-HLA-G cells by the MHGB688-derived variable region engineered on either IgG1 (MHGB688) or IgG4 (MHGB596). FIG. 16A shows NKL cell-mediated cytotoxicity; FIG. 16B shows NK-92 cell-mediated cytotoxicity.

Figure 17A:
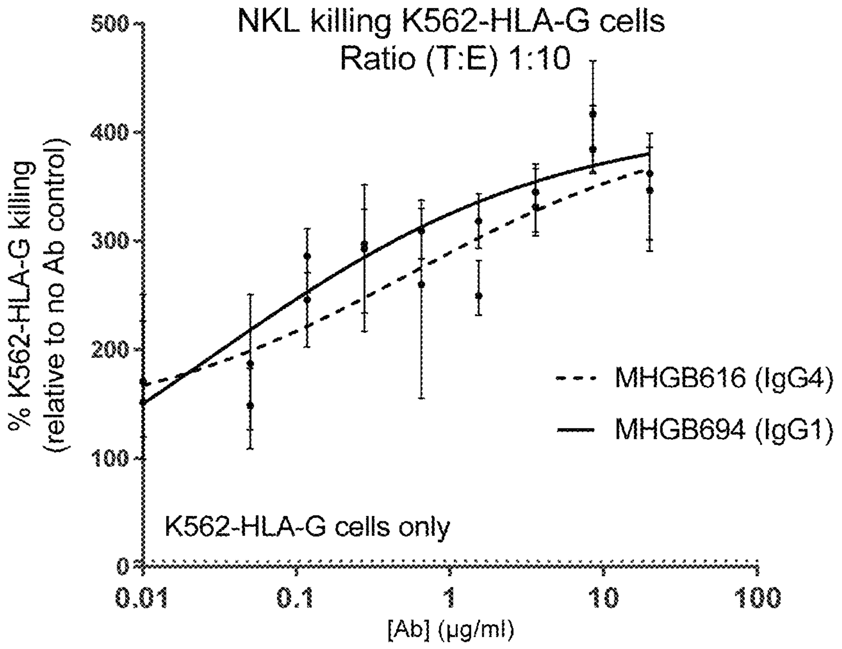
Figure 17B:
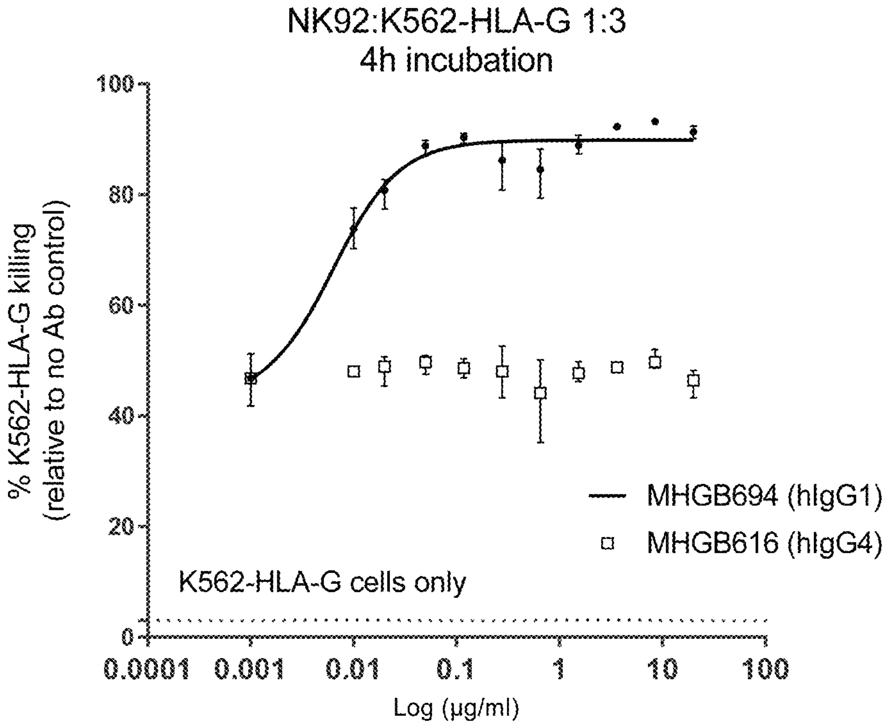

FIGS. 17A-17B show the enhancement of NK cell-mediated cytotoxicity of K562-HLA-G cells by the MHGB694-derived variable region engineered on either IgG1 (MHGB694) or IgG4 (MHGB616). FIG. 17A shows NKL cell-mediated cytotoxicity; FIG. 17B shows NK-92 cell-mediated cytotoxicity.

Figure 18A:
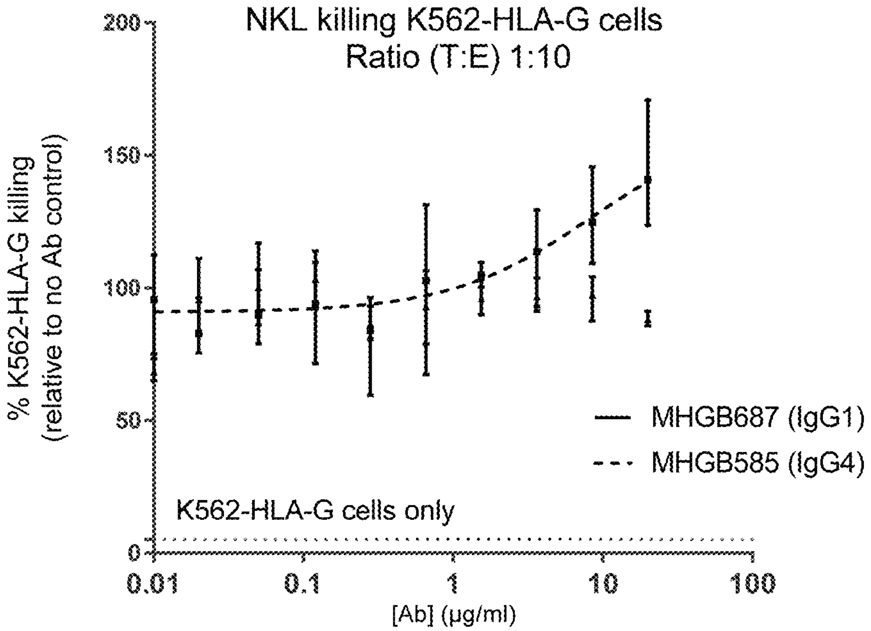
Figure 18B:
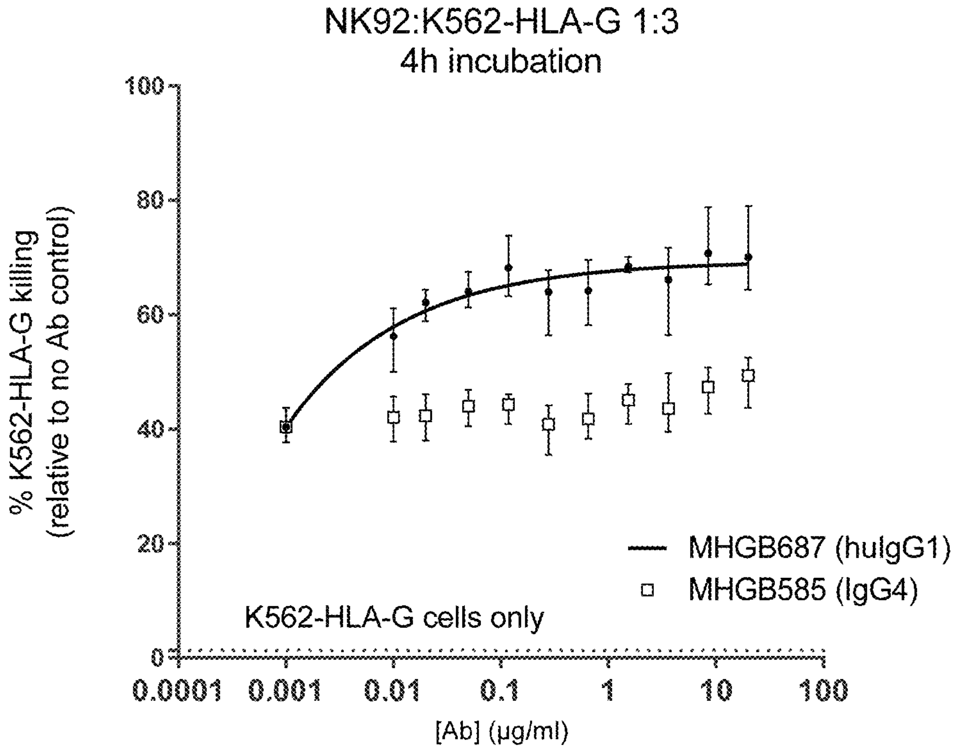

FIGS. 18A-18B show the enhancement of NK cell-mediated cytotoxicity of K562-HLA-G cells by the MHGB687-derived variable region engineered on either IgG1 (MHGB687) or IgG4 (MHGB585). FIG. 18A shows NKL cell-mediated cytotoxicity; FIG. 18B shows NK-92 cell-mediated cytotoxicity.

Figure 19A:
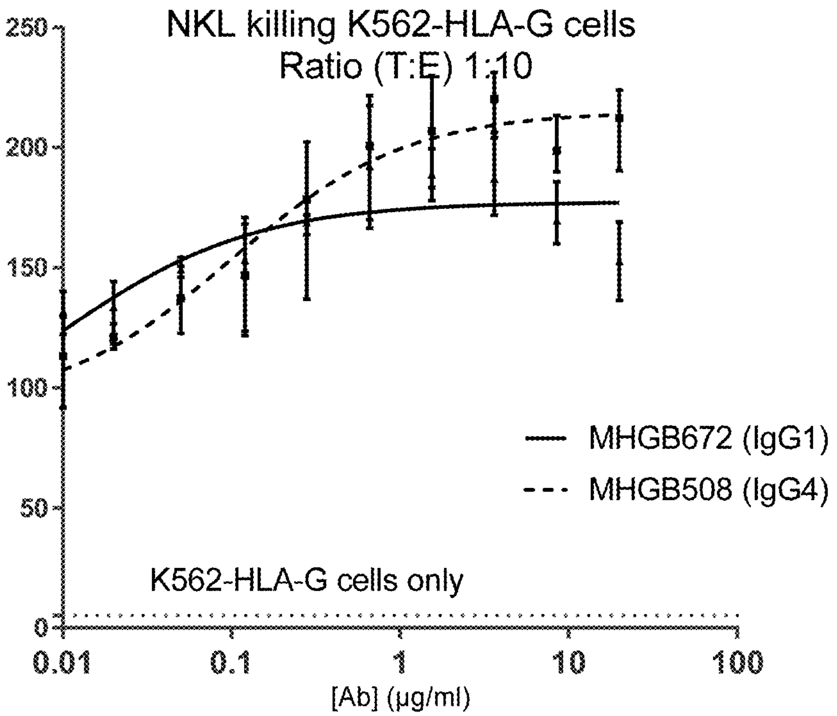
Figure 19B:
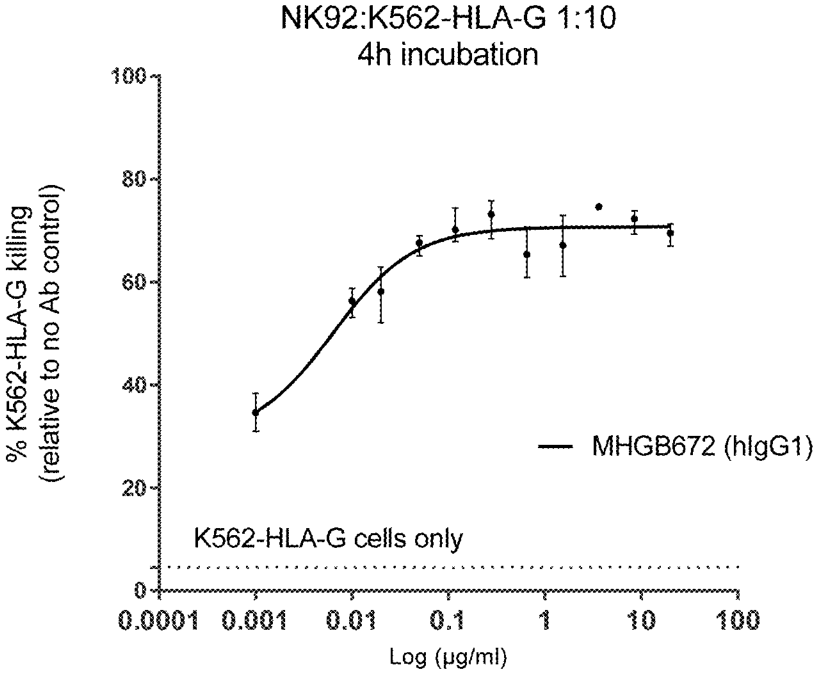

FIGS. 19A-19B show the enhancement of NK cell-mediated cytotoxicity of K562-HLA-G cells by the MHGB672-derived variable region engineered on either IgG1 (MHGB672) or IgG4 (MHGB508). FIG. 19A shows NKL cell-mediated cytotoxicity; FIG. 19B shows NK-92 cell-mediated cytotoxicity.

Figure 20:
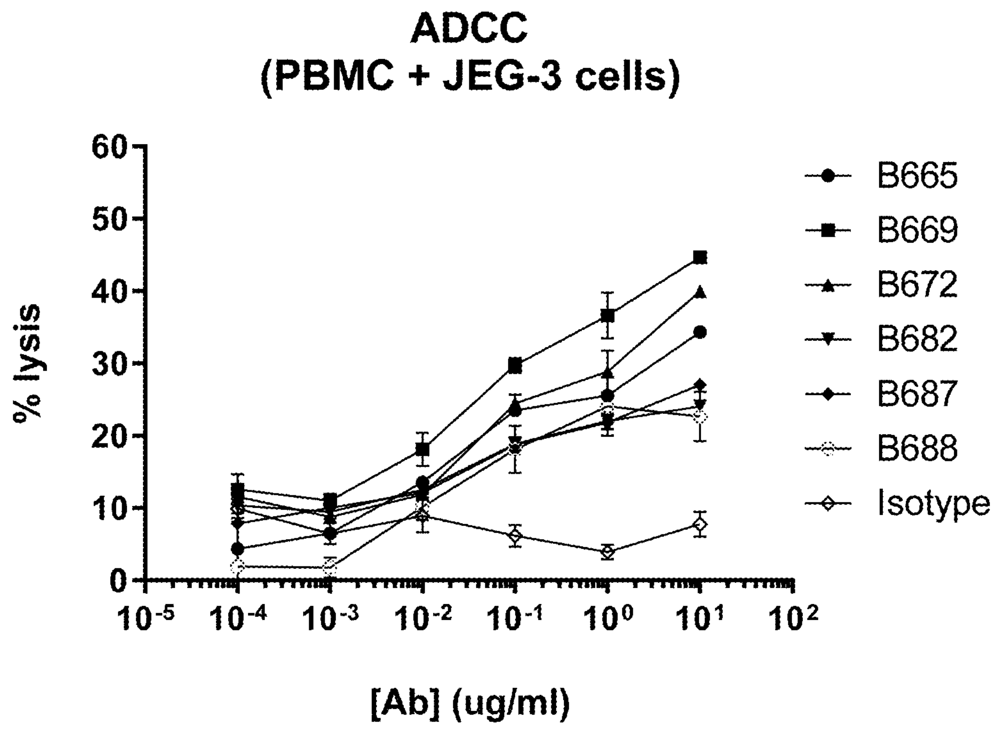

FIG. 20 shows ADCC activity against JEG-3 cells, mediated by the select antibodies MHGB665 ("B665"), MHGB669 ("B669"), MHGB672 ("B672"), MHGB682 ("B682"), MHGB687 ("B687"), and MHGB688 ("B688").

Figure 21A:
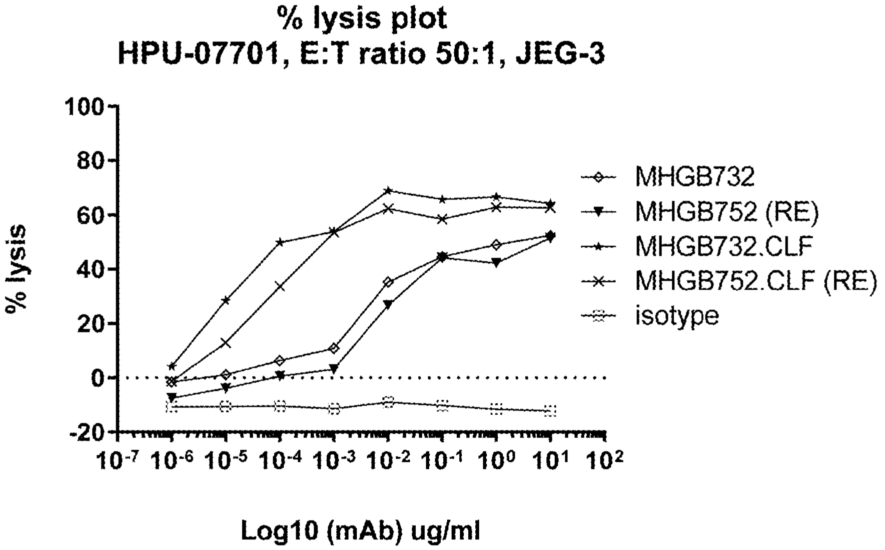
Figure 21B:
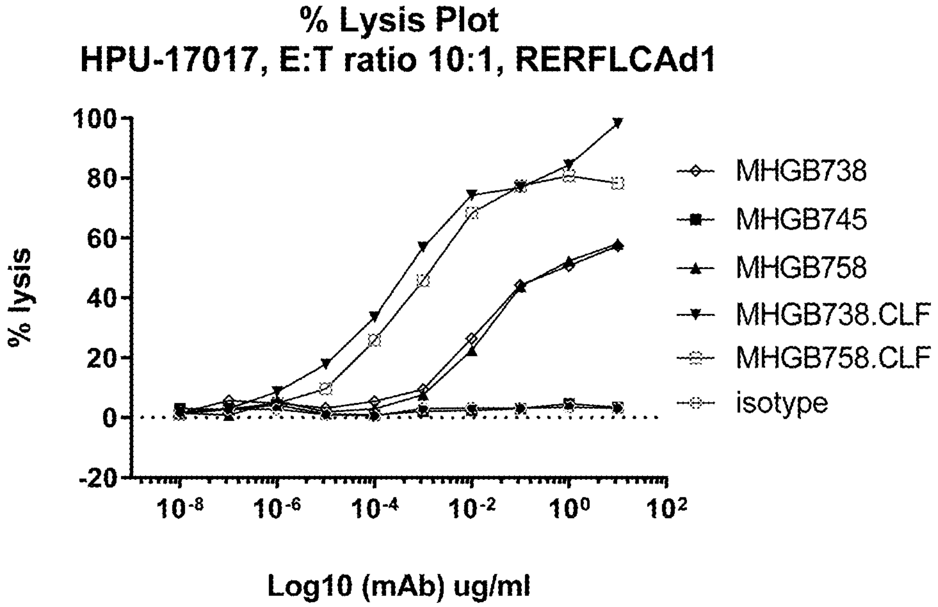

FIGS. 21A-21B show ADCC activity of the select antibodies.

Figure 21C:
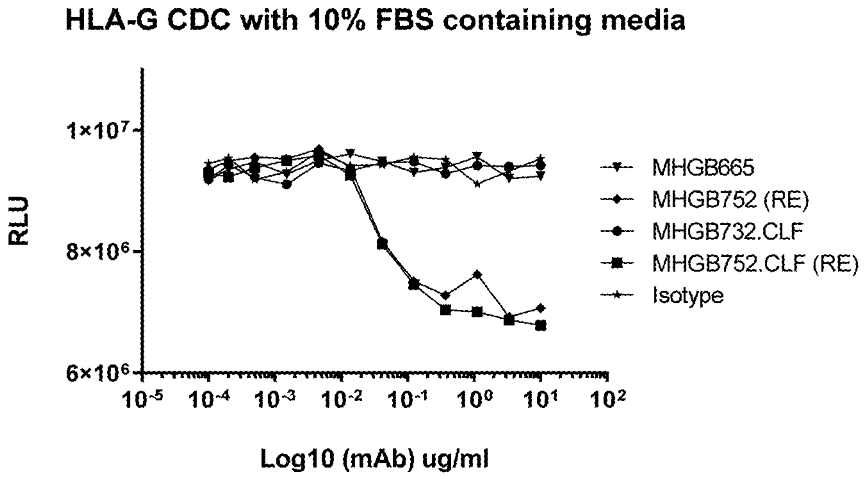
Figure 21D:
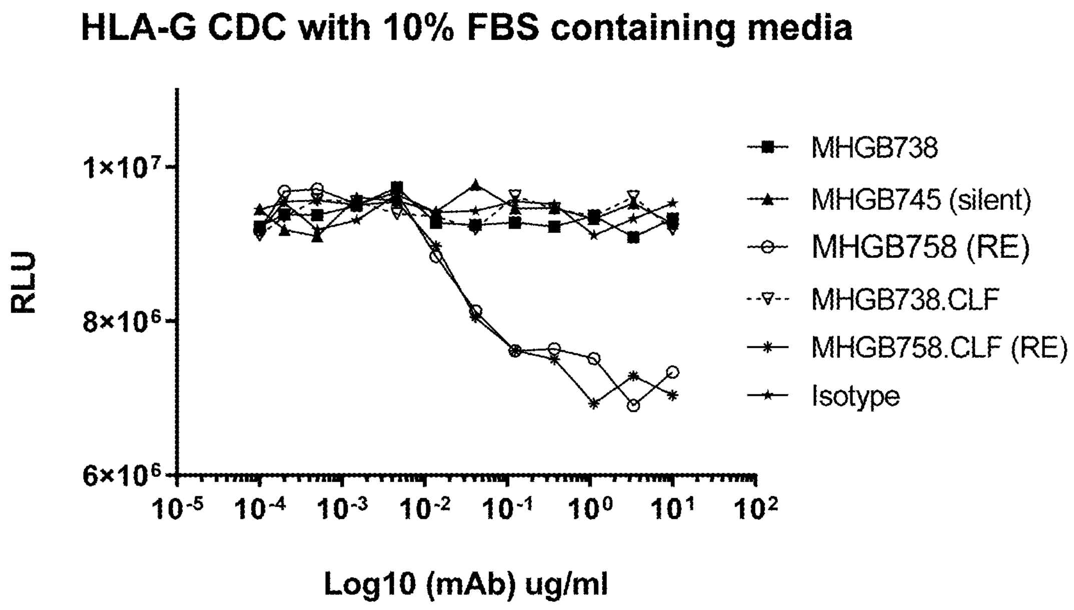

FIGS. 21C-21D show CDC activity of the select antibodies.

Figure 22A:
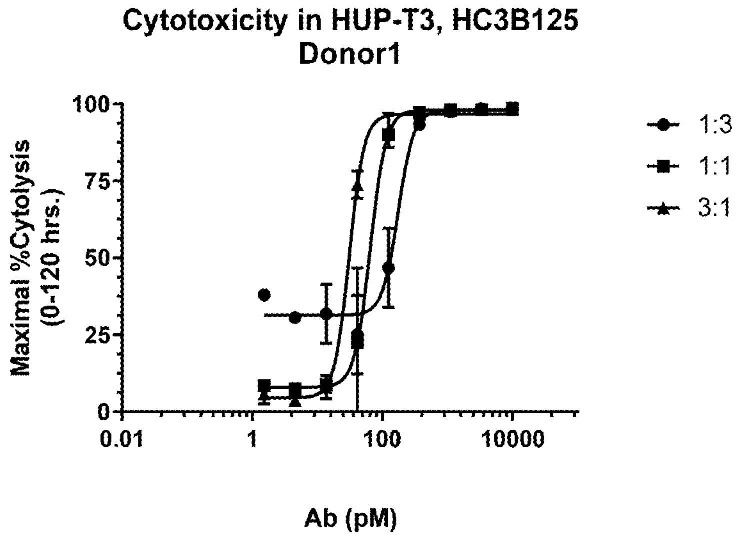
Figure 22B:
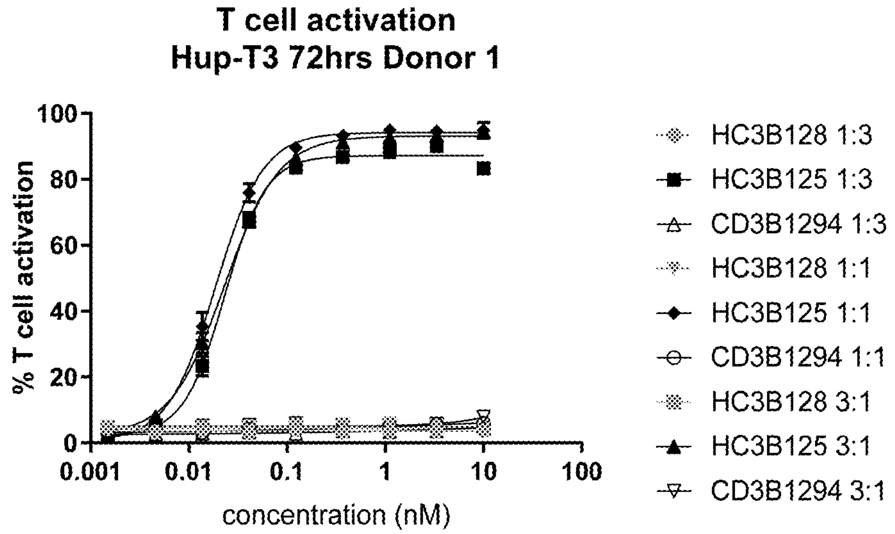

FIGS. 22A-22B show cytotoxicity of HC3B125 against HLA-G expressing tumor cells HUP-T3 and % T-cell activation.

Figure 22C:
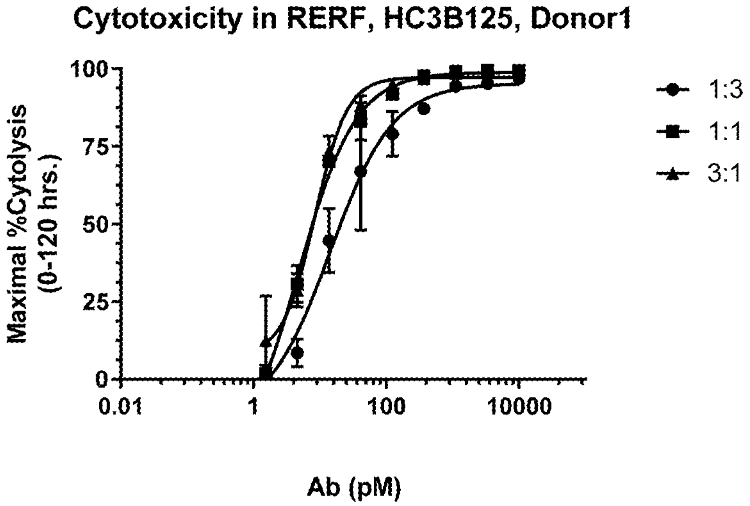
Figure 22D:
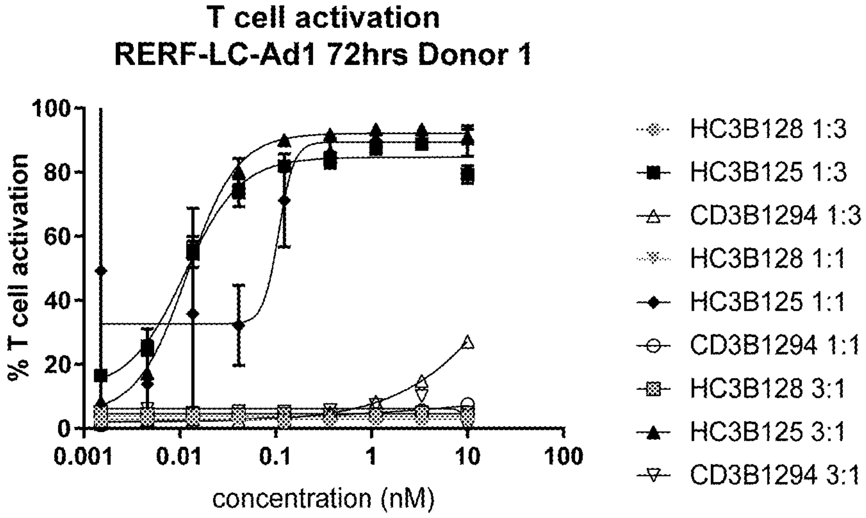

FIGS. 22C-22D show cytotoxicity of HC3B125 against HLA-G expressing tumor cells RERF-LC-Ad-1 and % T-cell activation.

Figure 23:
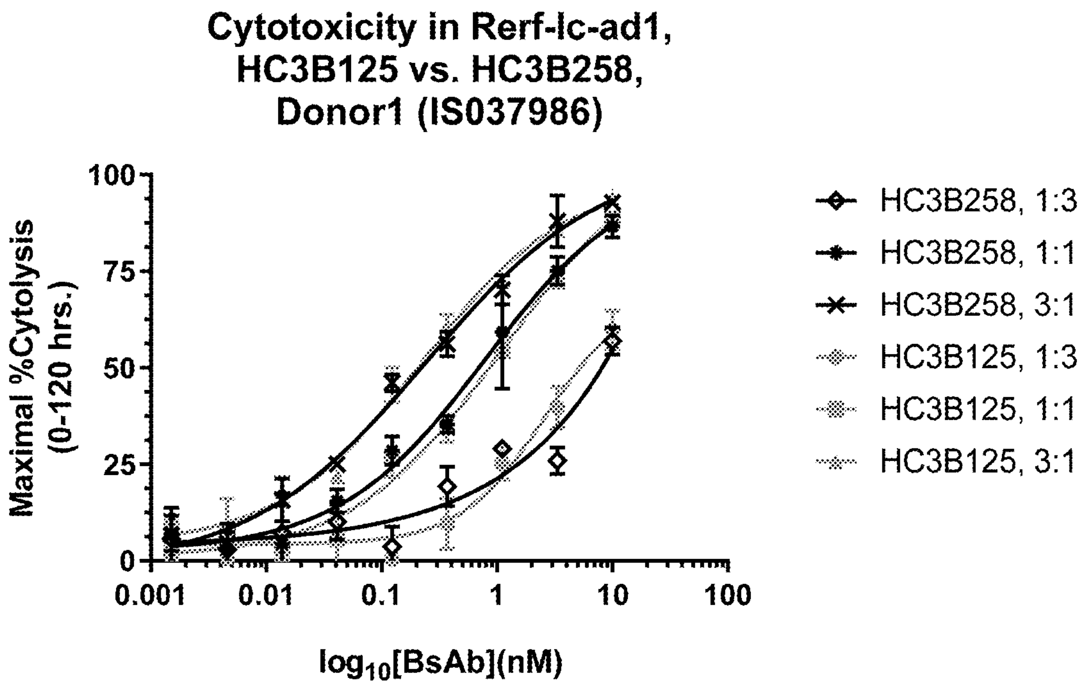

FIG. 23 shows cytotoxicity of HC3B258 and HC3B125 against RERF-LC-Ad-1 cells; Effector (T cell): Target (RERF-LC-Ad1) ratios were 1:3, 1:1, or 3:1, as indicated.

Figure 24A:
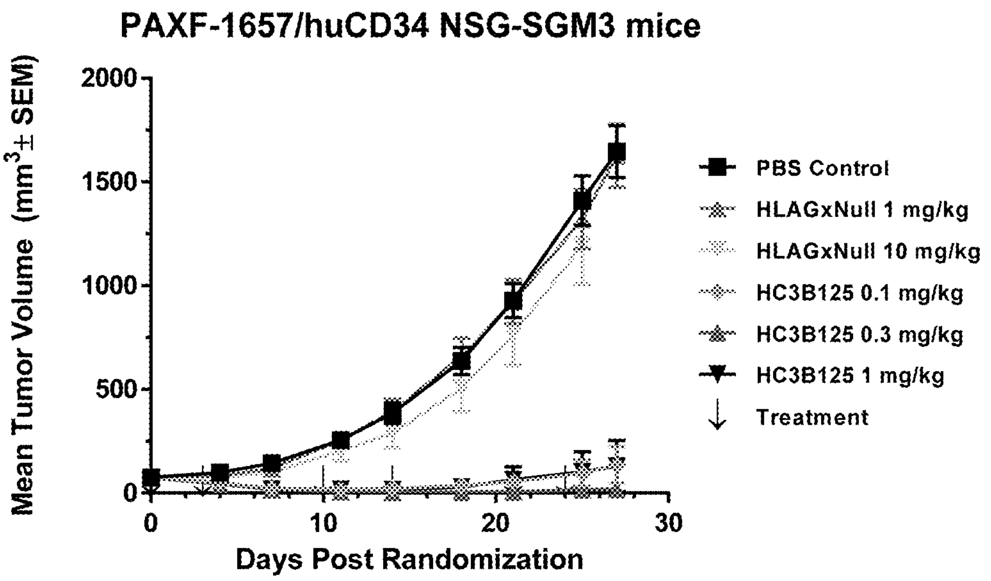
Figure 24B:
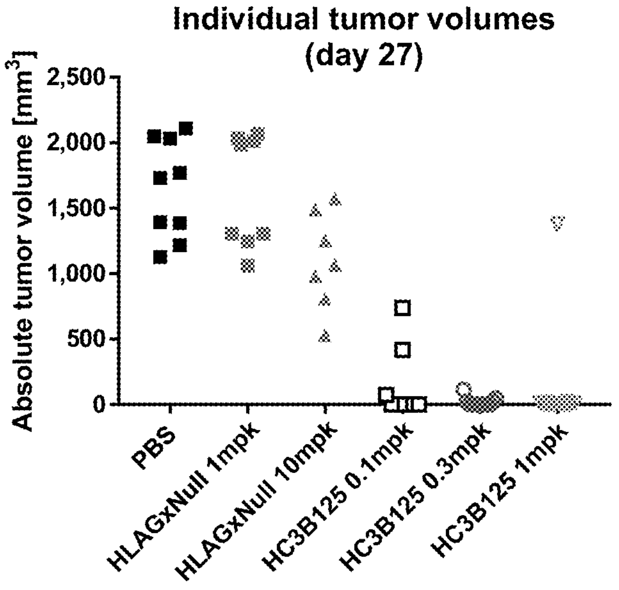

FIGS. 24A-24B show group mean tumor volumes (17A) and individual tumor volumes at day 27 of established pancreatic PDX in CD34+ cell humanized NSG-SGM3 mice treated with either control (HLA-G×Null) or HCB125.

Figure 25:
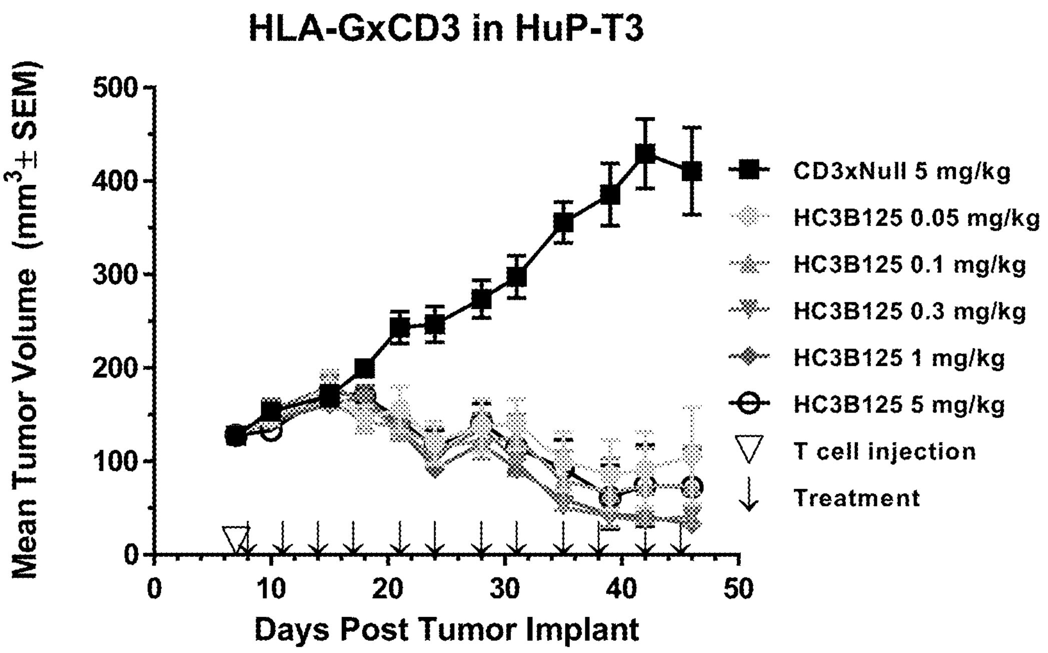

FIG. 25 shows group mean tumor volumes of established Hup-T3 xenografts in T cell humanized NSG mice treated with either control (CD3×Null) or HCB125.

Figure 26A:
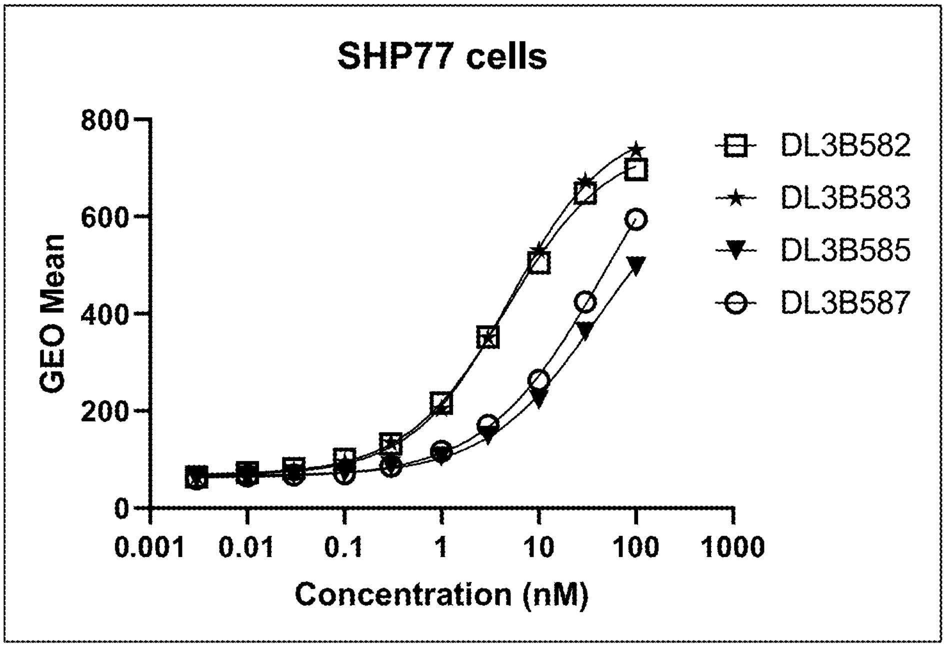
Figure 26B:
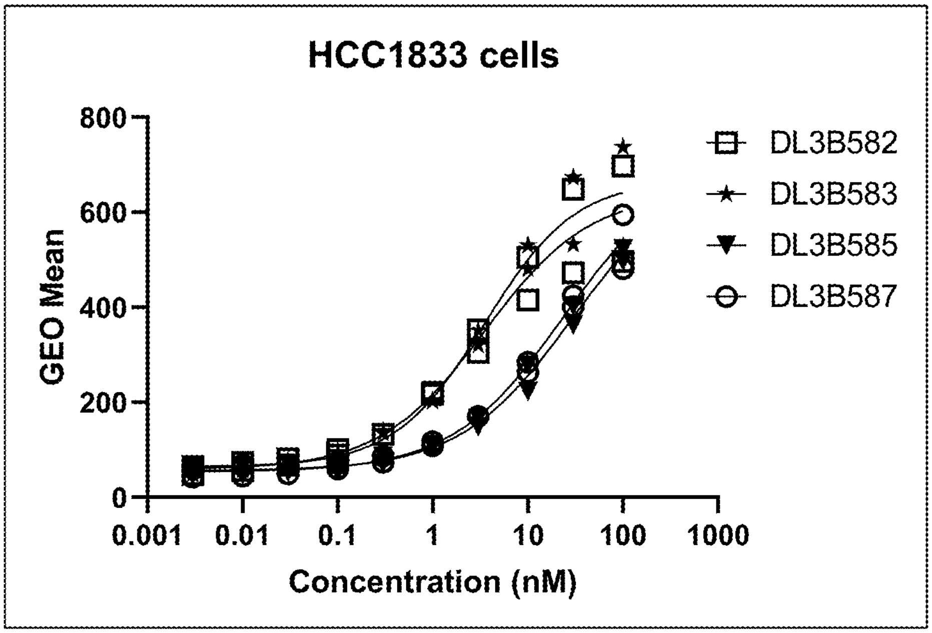

FIGS. 26A and 26B show cells binding of bispecific anti-DLL3×CD3 antibodies to DLL3$^{+}$ tumor cell lines. FIG.

26A shows cells binding of bispecific anti-DLL3×CD3 antibodies to DLL3$^+$ tumor cell lines, SHP77 cells. FIG. 26B shows cells binding of bispecific anti-DLL3×CD3 antibodies to DLL3$^+$ tumor cell lines, HCC1833 cells.

Figure 27:
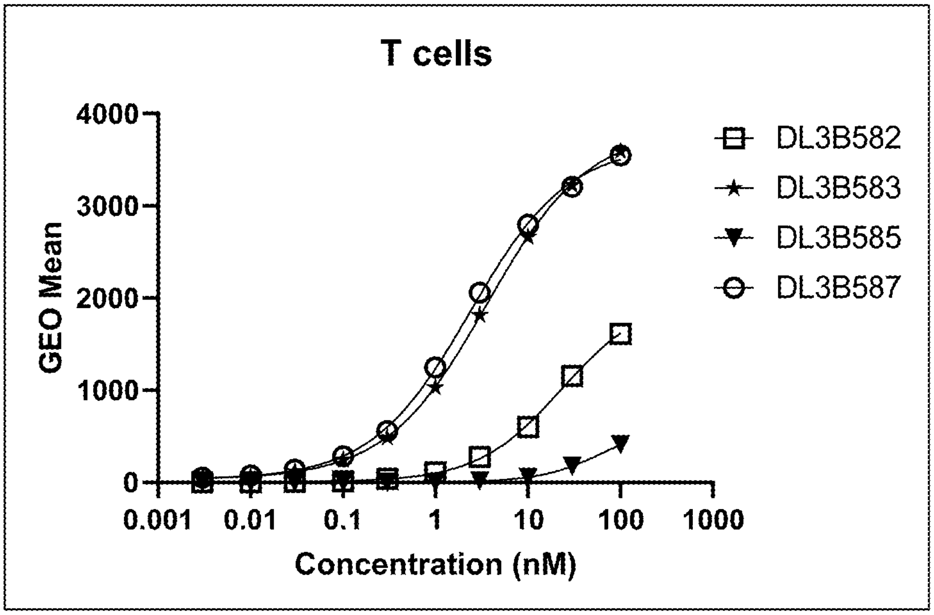

FIG. 27 shows binding of bispecific anti-DLL3×CD3 antibodies on human pan T cells using FACS.

Figure 28A:
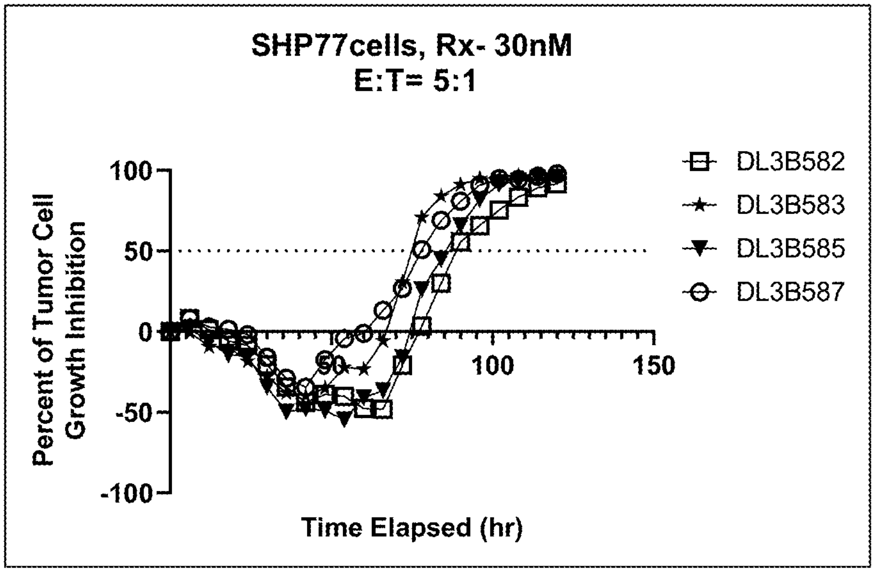
Figure 28B:
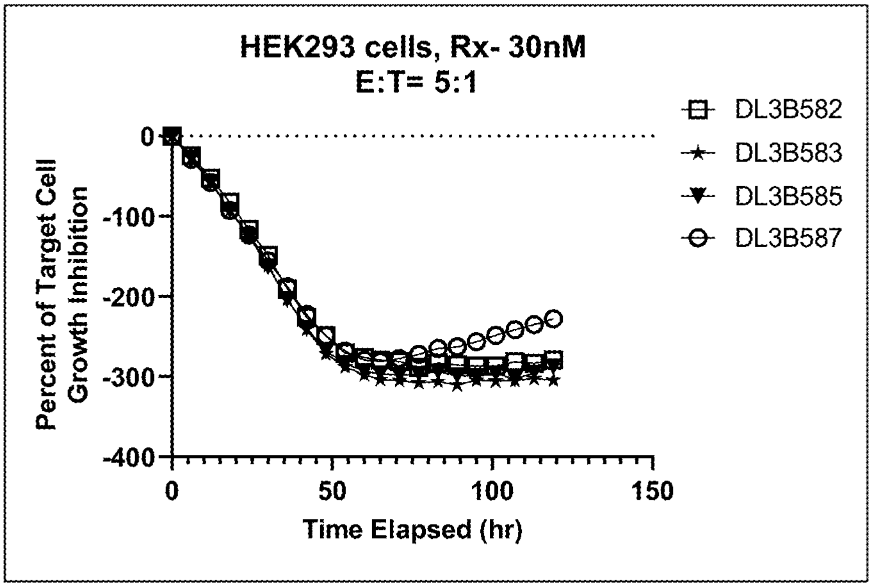

FIGS. 28A and 28B show in vitro target cytotoxicity of bispecific anti-DLL3×CD3 antibodies measured by incuCyte imaging system in real-time for quantifying target cell death. FIG. 28A shows in vitro target cytotoxicity of anti-DLL3×CD3 bispecific molecules measured by incuCyte imaging system in real-time for quantifying target cell death. Isolated pan-T cells were co-incubated with DLL3$^+$ SHP77 cells in the presence of bispecific anti-DLL3×CD3 antibodies for 120 hours. FIG. 28B shows in vitro target cytotoxicity of anti-DLL3×CD3 bispecific molecules measured by incuCyte imaging system in real-time for quantifying target cell death. Isolated pan-T cells were co-incubated with DLL3-HEK293 cells in the presence of bispecific anti-DLL3×CD3 antibodies for 120 hours.

Figure 29:
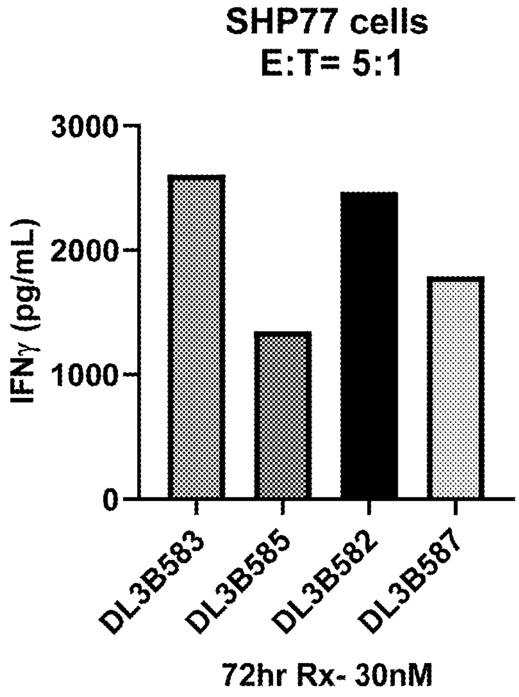

FIG. 29 shows in vitro T cell IFN-γ release by bispecific anti-DLL3×CD3 antibodies. IFN-γ concentration was measured from supernatants collected at the indicated time points.

Figure 30C:
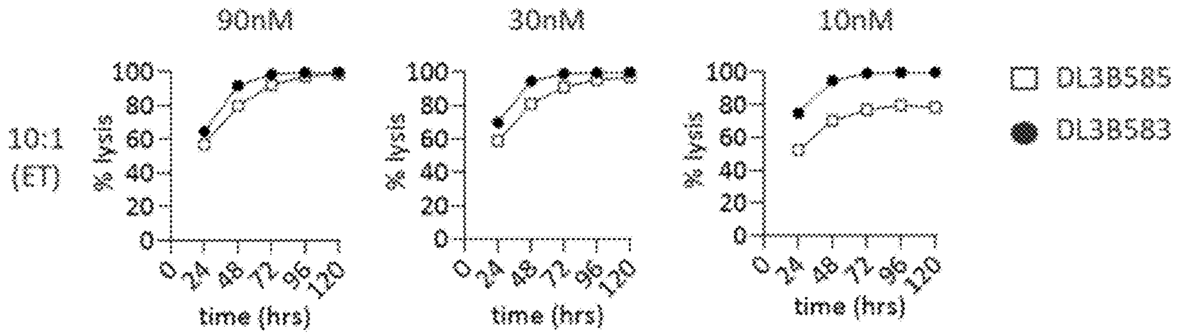
Figure 30A:
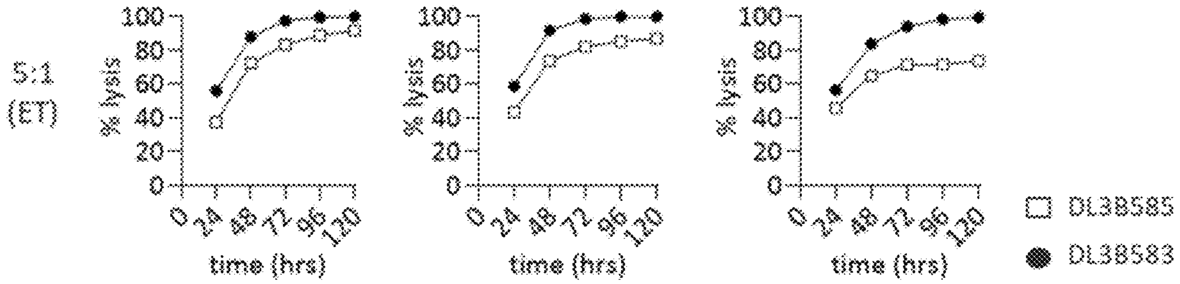
Figure 30B:
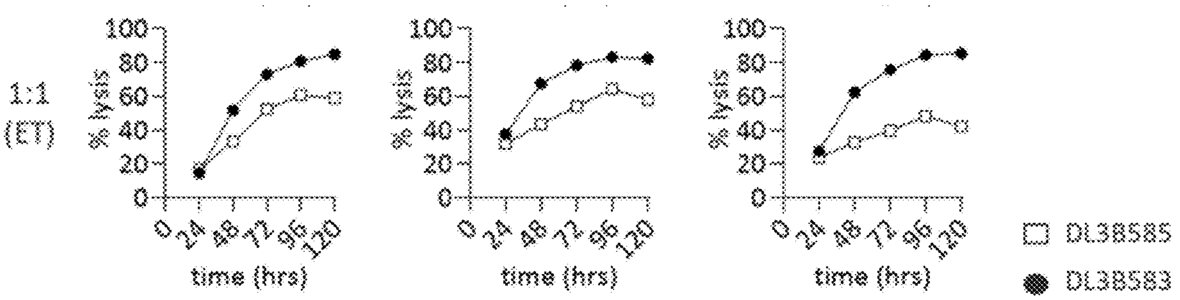

FIGS. 30A-30C show the cytotoxicity against DLL3$^+$ target cell lines in PBMCs mediated by bispecific anti-DLL3×CD3 antibodies. FIG. 30A shows the cytotoxicity against DLL3$^+$ target cell lines in PBMCs mediated by bispecific anti-DLL3×CD3 antibodies with an E:T ratio of 10:1. FIG. 30B shows the cytotoxicity against DLL3$^+$ target cell lines in PBMCs mediated by bispecific anti-DLL3×CD3 antibodies with an E:T ratio of 5:1. FIG. 30C shows the cytotoxicity against DLL3$^+$ target cell lines in PBMCs mediated by bispecific anti-DLL3×CD3 antibodies with an E:T ratio of 1:1.

Figure 31:
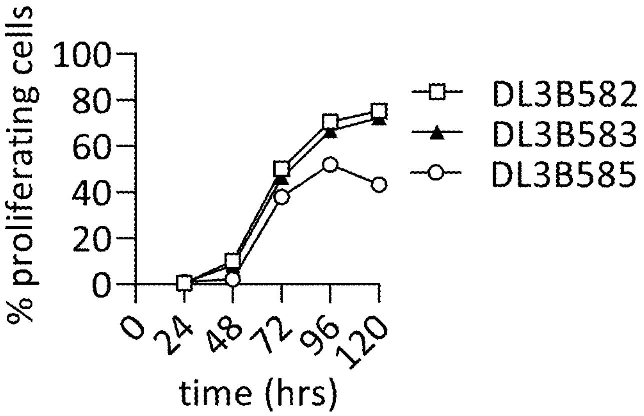

FIG. 31 shows proliferation of CD3$^+$ T cells in response to bispecific anti-DLL3×CD3 antibodies in whole PBMC cytotoxicity assay.

Figure 32A:
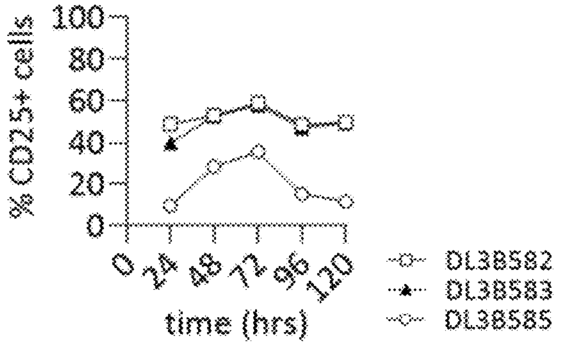
Figure 32B:
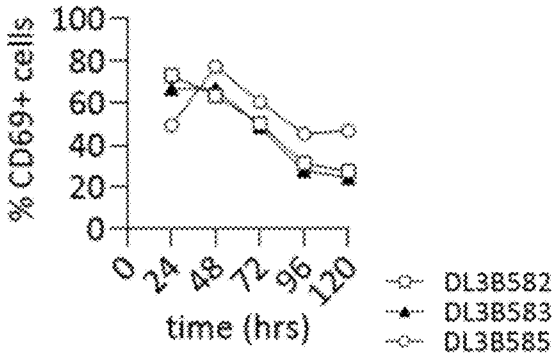
Figure 32C:
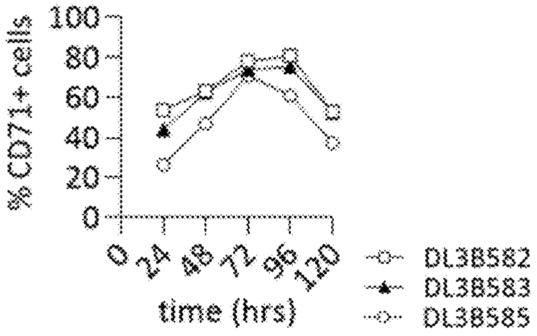

FIG. 32A-32C show activation of T cells in response to bispecific anti-DLL3×CD3 antibodies. FIG. 32A shows activation of T cells in response to bispecific anti-DLL3×CD3 antibodies % CD25$^+$ cells. FIG. 32B shows activation of T cells in response to bispecific anti-DLL3×CD3 antibodies % CD69$^+$ cells. FIG. 32C shows activation of T cells in response to bispecific anti-DLL3×CD3 antibodies % CD71$^+$ cells.

Figure 33A:
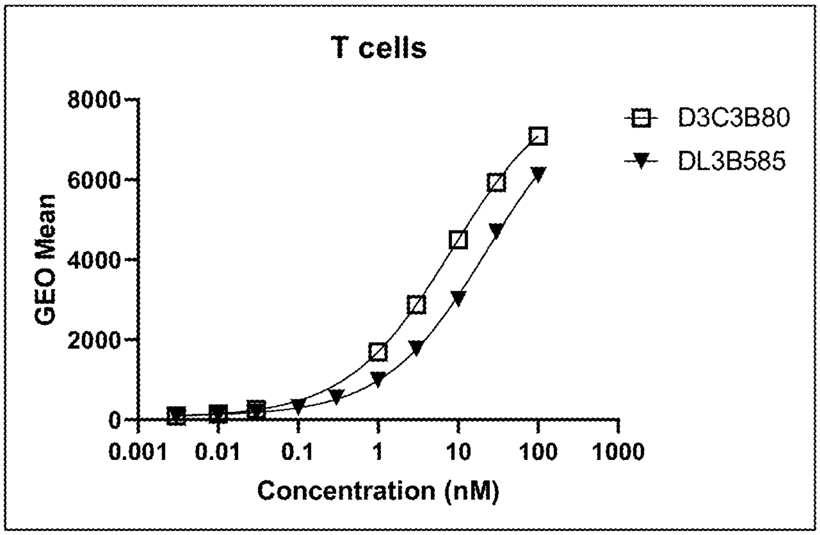
Figure 33B:
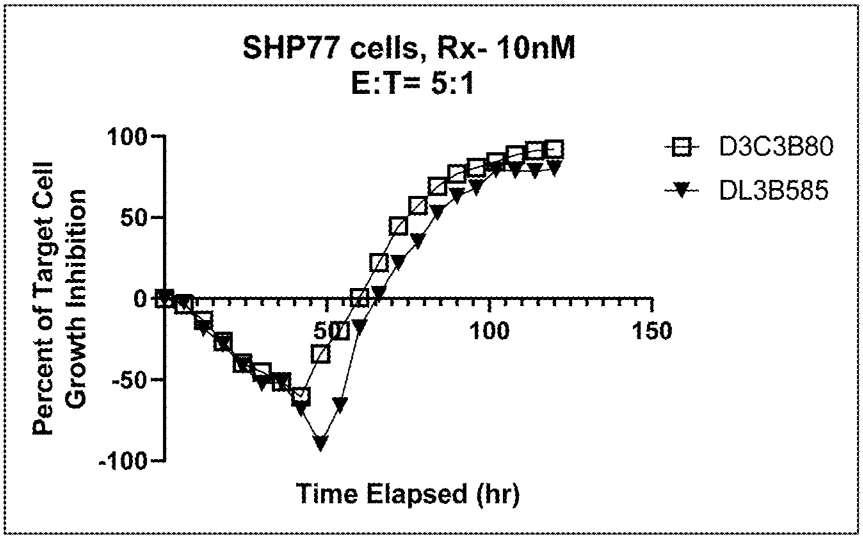

FIG. 33A-33B show the characteristics of the optimized bispecific anti-DLL3×CD3 antibody. FIG. 33A shows tumor Lysis of anti-DLL3×CD3 bispecific antibodies with and without optimized anti-DLL3 sequence evaluated in an IncuCyte-based cytotoxicity assay. FIG. 33B shows isolated pan-T cells were co-incubated with DLL3$^+$ SHP77 cells in the presence of bispecific DLL3/T cell redirection antibodies for 120 hours.

DETAILED DESCRIPTION OF THE INVENTION

All publications, including but not limited to patents and patent applications, cited in this specification are herein incorporated by reference as though fully set forth.

It is to be understood that the terminology used herein is for the purpose of describing particular embodiments only and is not intended to be limiting. Unless defined otherwise, all technical and scientific terms used herein have the same meaning as commonly understood by one of ordinary skill in the art to which the invention pertains.

Although any methods and materials similar or equivalent to those described herein may be used in the practice for testing of the present invention, exemplary materials and methods are described herein. In describing and claiming the present invention, the following terminology will be used.

When a list is presented, unless stated otherwise, it is to be understood that each individual element of that list, and every combination of that list, is a separate embodiment. For example, a list of embodiments presented as "A, B, or C" is to be interpreted as including the embodiments, "A," "B," "C," "A or B," "A or C," "B or C," or "A, B, or C."

As used in this specification and the appended claims, the singular forms "a," "an," and "the" include plural referents unless the content clearly dictates otherwise. Thus, for example, reference to "a cell" includes a combination of two or more cells, and the like.

The transitional terms "comprising," "consisting essentially of," and "consisting of" are intended to connote their generally accepted meanings in the patent vernacular; that is, (i) "comprising," which is synonymous with "including," "containing," or "characterized by," is inclusive or open-ended and does not exclude additional, unrecited elements or method steps; (ii) "consisting of" excludes any element, step, or ingredient not specified in the claim; and (iii) "consisting essentially of" limits the scope of a claim to the specified materials or steps "and those that do not materially affect the basic and novel characteristic(s)" of the claimed invention. Embodiments described in terms of the phrase "comprising" (or its equivalents) also provide as embodiments those independently described in terms of "consisting of" and "consisting essentially of"

"About" means within an acceptable error range for the particular value as determined by one of ordinary skill in the art, which will depend in part on how the value is measured or determined, i.e., the limitations of the measurement system. Unless explicitly stated otherwise within the Examples or elsewhere in the Specification in the context of a particular assay, result or embodiment, "about" means within one standard deviation per the practice in the art, or a range of up to 5%, whichever is larger.

"Activation" or "stimulation" or "activated" or "stimulated" refers to induction of a change in the biologic state of a cell resulting in expression of activation markers, cytokine production, proliferation or mediating cytotoxicity of target cells. Cells may be activated by primary stimulatory signals. Co-stimulatory signals can amplify the magnitude of the primary signals and suppress cell death following initial stimulation resulting in a more durable activation state and thus a higher cytotoxic capacity. A "co-stimulatory signal" refers to a signal, which in combination with a primary signal, such as TCR/CD3 ligation, leads to T cell and/or NK cell proliferation and/or upregulation or downregulation of key molecules.

"Alternative scaffold" refers to a single chain protein framework that contains a structured core associated with variable domains of high conformational tolerance. The variable domains tolerate variation to be introduced without compromising scaffold integrity, and hence the variable domains can be engineered and selected for binding to a specific antigen.

"Antibody-dependent cellular cytotoxicity", "antibody-dependent cell-mediated cytotoxicity" or "ADCC" refers to the mechanism of inducing cell death that depends upon the interaction of antibody-coated target cells with effector cells possessing lytic activity, such as natural killer cells (NK), monocytes, macrophages and neutrophils via Fc gamma receptors (FcγR) expressed on effector cells.

"Antibody-dependent cellular phagocytosis" or "ADCP" refers to the mechanism of elimination of antibody-coated target cells by internalization by phagocytic cells, such as macrophages or dendritic cells.

"Antigen" refers to any molecule (e.g., protein, peptide, polysaccharide, glycoprotein, glycolipid, nucleic acid, portions thereof, or combinations thereof) capable of being bound by an antigen binding domain or a T-cell receptor that is capable of mediating an immune response. Exemplary immune responses include antibody production and activation of immune cells, such as T cells, B cells or NK cells. Antigens may be expressed by genes, synthetized, or purified from biological samples such as a tissue sample, a tumor sample, a cell or a fluid with other biological components, organisms, subunits of proteins/antigens, killed or inactivated whole cells or lysates.

"Antigen binding fragment" or "antigen binding domain" refers to a portion of the protein that binds an antigen. Antigen binding fragments may be synthetic, enzymatically obtainable or genetically engineered polypeptides and include portions of an immunoglobulin that bind an antigen, such as the VH, the VL, the VH and the VL, Fab, Fab', $F(ab')_2$, Fd and Fv fragments, domain antibodies (dAb) consisting of one VH domain or one VL domain, shark variable IgNAR domains, camelized VH domains, VHH domains, minimal recognition units consisting of the amino acid residues that mimic the CDRs of an antibody, such as FR3-CDR3-FR4 portions, the HCDR1, the HCDR2 and/or the HCDR3 and the LCDR1, the LCDR2 and/or the LCDR3, alternative scaffolds that bind an antigen, and multispecific proteins comprising the antigen binding fragments. Antigen binding fragments (such as VH and VL) may be linked together via a synthetic linker to form various types of single antibody designs where the VH/VL domains may pair intramolecularly, or intermolecularly in those cases when the VH and VL domains are expressed by separate single chains, to form a monovalent antigen binding domain, such as single chain Fv (scFv) or diabody. Antigen binding fragments may also be conjugated to other antibodies, proteins, antigen binding fragments or alternative scaffolds which may be monospecific or multispecific to engineer bispecific and multispecific proteins.

"Antibodies" is meant in a broad sense and includes immunoglobulin molecules including monoclonal antibodies including murine, human, humanized and chimeric monoclonal antibodies, antigen binding fragments, multispecific antibodies, such as bispecific, trispecific, tetraspecific etc., dimeric, tetrameric or multimeric antibodies, single chain antibodies, domain antibodies and any other modified configuration of the immunoglobulin molecule that comprises an antigen binding site of the required specificity. "Full length antibodies" are comprised of two heavy chains (HC) and two light chains (LC) inter-connected by disulfide bonds as well as multimers thereof (e.g. IgM). Each heavy chain is comprised of a heavy chain variable region (VH) and a heavy chain constant region (comprised of domains CH1, hinge, CH2 and CH3). Each light chain is comprised of a light chain variable region (VL) and a light chain constant region (CL). The VH and the VL regions may be further subdivided into regions of hypervariability, termed complementarity determining regions (CDR), interspersed with framework regions (FR). Each VH and VL is composed of three CDRs and four FR segments, arranged from amino-to-carboxy-terminus in the following order: FR1, CDR1, FR2, CDR2, FR3, CDR3 and FR4. Immunoglobulins may be assigned to five major classes, IgA, IgD, IgE, IgG and IgM, depending on the heavy chain constant domain amino acid sequence. IgA and IgG are further sub-classified as the isotypes IgA1, IgA2, IgG1, IgG2, IgG3 and IgG4. Antibody light chains of any vertebrate species may be assigned to one of two clearly distinct types, namely kappa (κ) and lambda (λ), based on the amino acid sequences of their constant domains.

"Bispecific" refers to a molecule (such as a protein or an antibody) that specifically binds two distinct antigens or two distinct epitopes within the same antigen. The bispecific molecule may have cross-reactivity to other related antigens, for example to the same antigen from other species (homologs), such as human or monkey, for example *Macaca cynomolgus* (cynomolgus, cyno) or *Pan troglodytes*, or may bind an epitope that is shared between two or more distinct antigens.

"Bispecific anti-hK2/anti-CD3 antibody", "hk2/CD3 antibody", "hk2×CD3 antibody," "anti-hK2/anti-CD3 protein," and the like refer to an antibody that binds hk2 and CD3 and that comprises at least one binding domain specifically binding hK2 and at least one binding domain specifically binding CD3. The domains specifically binding hK2 and CD3 are typically $V_H/V_L$ pairs. The bispecific anti-hk2×CD3 antibody may be monovalent in terms of its binding to either hk2 or CD3.

"Bispecific anti-HLA-G/anti-CD3 antibody", "HLA-G/CD3 antibody", "HLA-G×CD3 antibody," "anti-HLA-G/anti-CD3 protein," and the like refer to an antibody that binds HLA-G and CD3 and that comprises at least one binding domain specifically binding HLA-G and at least one binding domain specifically binding CD3. The domains specifically binding HLA-G and CD3 are typically $V_H/V_L$ pairs. The bispecific anti-HLA-G×CD3 antibody may be monovalent in terms of its binding to either HLA-G or CD3.

"Bispecific anti-DLL3/anti-CD3 antibody", "anti-DLL3×CD3", "DLL3/CD3 antibody", "DLL3×CD3 antibody," "anti-DLL3/anti-CD3 protein," and the like refer to an antibody that binds DLL3 and CD3 and that comprises at least one binding domain specifically binding DLL3 and at least one binding domain specifically binding CD3. The domains specifically binding DLL3 and CD3 are typically $V_H/V_L$ pairs. The bispecific anti-DLL3×CD3 antibody may be monovalent in terms of its binding to either DLL3 or CD3.

"Cancer" refers to a broad group of various diseases characterized by the uncontrolled growth of abnormal cells in the body. Unregulated cell division and growth results in the formation of malignant tumors that invade neighboring tissues and may also metastasize to distant parts of the body through the lymphatic system or bloodstream. A "cancer" or "cancer tissue" can include a tumor.

"Cluster of Differentiation 3 ε" or "CD3ε" refers to a known protein which is also called "T-cell surface glycoprotein CD3 epsilon chain", or "T3E". CD3ε, together with CD3-gamma, -delta and -zeta, and the T-cell receptor alpha/beta and gamma/delta heterodimers, forms the T-cell receptor-CD3 complex. This complex plays an important role in coupling antigen recognition to several intracellular signal-transduction pathways. The CD3 complex mediates signal transduction, resulting in T cell activation and proliferation. CD3 is required for the immune response. The amino acid sequence of a full length CD3ε is shown in SEQ ID NO: 1. The amino acid sequence of the extracellular domain (ECD) of CD3ε is shown in SEQ ID NO: 2. Throughout the specification, "CD3ε-specific" or "specifically binds CD3ε" or "anti-CD3ε antibody" refers to antibodies that bind specifically to the CD3ε polypeptide (SEQ ID NO: 1), including antibodies that bind specifically to the CD3ε extracellular domain (ECD) (SEQ ID NO: 2).

```
(Human CD3 epsilon)
                                        SEQ ID NO: 1
MQSGTHWRVLGLCLLSVGVWGQDGNEEMGGITQTPYKVSISGTTVILTCP

QYPGSEILWQHNDKNIGGDEDDKNIGSDEDHLSLKEFSELEQSGYYVCYP

RGSKPEDANFYLYLRARVCENCMEMDVMSVATIVIVDICITGGLLLLVYY

WSKNRKAKAKPVTRGAGAGGRQRGQNKERPPPVPNPDYEPIRKGQRDLYS

GLNQRRI

(Human CD3 epsilon extracellular domain)
                                        SEQ ID NO: 2
DGNEEMGGITQTPYKVSISGTTVILTCPQYPGSEILWQHNDKNIGGDEDD

KNIGSDEDHLSLKEFSELEQSGYYVCYPRGSKPEDANFYLYLRARVCENC

MEMD
```

"Complement-dependent cytotoxicity" or "CDC", refers to the mechanism of inducing cell death in which the Fc effector domain of a target-bound protein binds and activates complement component C1q which in turn activates the complement cascade leading to target cell death. Activation of complement may also result in deposition of complement components on the target cell surface that facilitate CDC by binding complement receptors (e.g., CR3) on leukocytes.

"Complementarity determining regions" (CDR) are antibody regions that bind an antigen. There are three CDRs in the VH (HCDR1, HCDR2, HCDR3) and three CDRs in the VL (LCDR1, LCDR2, LCDR3). CDRs may be defined using various delineations such as Kabat (Wu et al. (1970) J Exp Med 132:211-50; Kabat et al., Sequences of Proteins of Immunological Interest, 5th Ed. Public Health Service, National Institutes of Health, Bethesda, Md., 1991), Chothia (Chothia et al. (1987) J Mol Biol 196:90-17), IMGT (Lefranc et al. (2003) Dev Comp Immunol 27:55-77; Honeggar and Pluckthun, J Mol Biol (2001) 309:657-70; International ImMunoGeneTics (IMGT) database; Web resources (for example, can be retrieved from the Internet. Available programs such as abYsis by UCL Business PLC may be used to delineate CDRs. The term "CDR", "HCDR1", "HCDR2", "HCDR3", LCDR1", LCDR2" and "LCDR3" as used herein includes CDRs defined by any of the methods described supra, Kabat, Chothia, IMGT or AbM, unless otherwise explicitly stated in the specification.

"Decrease," "lower," "lessen," "reduce," or "abate" refers generally to the ability of a test molecule to mediate a reduced response (i.e., downstream effect) when compared to the response mediated by a control or a vehicle. Exemplary responses are T cell expansion, T cell activation or T-cell mediated tumor cell killing or binding of a protein to its antigen or receptor, enhanced binding to a Fcγ or enhanced Fc effector functions such as enhanced ADCC, CDC and/or ADCP. Decrease may be a statistically significant difference in the measured response between the test molecule and the control (or the vehicle), or a decrease in the measured response, such as a decrease of about 1.1, 1.2, 1.5, 2, 3, 4, 5, 6, 7, 8, 9, 10, 15, 20 or 30 fold or more, such as 500, 600, 700, 800, 900 or 1000 fold or more (including all integers and decimal points in between and above 1, e.g., 1.5, 1.6, 1.7, 1.8, etc.).

"Differentiation" refers to a method of decreasing the potency or proliferation of a cell or moving the cell to a more developmentally restricted state.

"Delta-like protein 3" or "DLL3" refers to a known protein which is also called delta-like 3, delta 3, or drosophila Delta homolog 3. Unless specified, as used herein, DLL3 refers to human DLL3. All DLL3 isoforms and variants are encompassed in "DLL3". The amino acid sequences of the various isoforms are retrievable from NCBI accession numbers NP_058637.1 (isoform 1 precursor, 618 amino acids) and NP_982353.1 (isoform 2 precursor, 587 amino acids). The amino acid sequence of a full length DLL3 is shown in SEQ ID NO: 255. The sequence of DLL3 includes the DSL domain (residues 176-215), EGF-1 domain (residues 216-249), EGF-2 domain (residues 274-310), EGF-3 domain (residues 312-351), EGF-4 domain (residues 353-389), EGF-5 domain (residues 391-427), and EGF-6 domain (residues 429-465).

```
>(NP_058637.1 delta-like protein 3 isoform 1
precursor [Homo sapiens])
                                        SEQ ID NO: 716
MVSPRMSGLLSQTVILALIFLPQTRPAGVFELQIHSFGPGPGPGAPRSPC

SARLPCRLFFRVCLKPGLSEEAAESPCALGAALSARGPVYTEQPGAPAPD

LPLPDGLLQVPFRDAWPGTFSFIIETWREELGDQIGGPAWSLLARVAGRR

RLAAGGPWARDIQRAGAWELRFSYRARCEPPAVGTACTRLCRPRSAPSRC

GPGLRPCAPLEDECEAPLVCRAGCSPEHGFCEQPGECRCLEGWTGPLCTV

PVSTSSCLSPRGPSSATTGCLVPGPGPCDGNPCANGGSCSETPRSFECTC

PRGFYGLRCEVSGVTCADGPCFNGGLCVGGADPDSAYICHCPPGFQGSNC

EKRVDRCSLQPCRNGGLCLDLGHALRCRCRAGFAGPRCEHDLDDCAGRAC

ANGGTCVEGGGAHRCSCALGFGGRDCRERADPCAARPCAHGGRCYAHFSG

LVCACAPGYMGARCEFPVHPDGASALPAAPPGLRPGDPQRYLLPPALGLL

VAAGVAGAALLLVHVRRRGHSQDAGSRLLAGTPEPSVHALPDALNNLRTQ

EGSGDGPSSSVDWNRPEDVDPQGIYVISAPSIYAREVATPLFPPLHTGRA

GQRQHLLFPYPSSILSVK
```

"Encode" or "encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (e.g., rRNA, tRNA and mRNA) or a defined sequence of amino acids and the biological properties resulting therefrom. Thus, a gene, cDNA, or RNA, encodes a protein if transcription and translation of mRNA corresponding to that gene produces the protein in a cell or other biological system. Both the coding strand, the nucleotide sequence of which is identical to the mRNA sequence, and the non-coding strand, used as the template for transcription of a gene or cDNA, can be referred to as encoding the protein or other product of that gene or cDNA.

"Enhance," "promote," "increase," "expand" or "improve" refers generally to the ability of a test molecule to mediate a greater response (i.e., downstream effect) when compared to the response mediated by a control or a vehicle. Exemplary responses are T cell expansion, T cell activation or T-cell mediated tumor cell killing or binding of a protein to its antigen or receptor, enhanced binding to a Fcγ or enhanced Fc effector functions such as enhanced ADCC, CDC and/or ADCP. Enhance may be a statistically significant difference in the measured response between the test molecule and control (or vehicle), or an increase in the measured response, such as an increase of about 1.1, 1.2, 1.5, 2, 3, 4, 5, 6, 7, 8, 9, 10, 15, 20 or 30 fold or more, such as 500, 600, 700, 800, 900 or 1000 fold or more (including all integers and decimal points in between and above 1, e.g., 1.5, 1.6, 1.7, 1.8, etc.).

"Epitope" refers to a portion of an antigen to which an antibody, or the antigen binding portion thereof, specifically binds. Epitopes typically consist of chemically active (such as polar, non-polar or hydrophobic) surface groupings of moieties such as amino acids or polysaccharide side chains and may have specific three-dimensional structural characteristics, as well as specific charge characteristics. An epitope may be composed of contiguous and/or discontiguous amino acids that form a conformational spatial unit. For a discontiguous epitope, amino acids from differing portions of the linear sequence of the antigen come in close proximity in 3-dimensional space through the folding of the protein molecule. Antibody "epitope" depends on the methodology used to identify the epitope.

"Expansion" refers to the outcome of cell division and cell death.

"Express" and "expression" refers the to the well-known transcription and translation occurring in cells or in vitro. The expression product, e.g., the protein, is thus expressed by the cell or in vitro and may be an intracellular, extracellular or a transmembrane protein.

"Expression vector" refers to a vector that can be utilized in a biological system or in a reconstituted biological system to direct the translation of a polypeptide encoded by a polynucleotide sequence present in the expression vector.

"dAb" or "dAb fragment" refers to an antibody fragment composed of a VH domain (Ward et al., Nature 341:544 546 (1989)).

"Fab" or "Fab fragment" refers to an antibody fragment composed of VH, CH1, VL and CL domains.

"$F(ab')_2$" or "$F(ab')_2$ fragment" refers to an antibody fragment containing two Fab fragments connected by a disulfide bridge in the hinge region.

"Fd" or "Fd fragment" refers to an antibody fragment composed of VH and CH1 domains.

"Fv" or "Fv fragment" refers to an antibody fragment composed of the VH and the VL domains from a single arm of the antibody.

"Full length antibody" is comprised of two heavy chains (HC) and two light chains (LC) inter-connected by disulfide bonds as well as multimers thereof (e.g. IgM). Each heavy chain is comprised of a heavy chain variable domain (VH) and a heavy chain constant domain, the heavy chain constant domain comprised of subdomains CH1, hinge, CH2 and CH3. Each light chain is comprised of a light chain variable domain (VL) and a light chain constant domain (CL). The VH and the VL may be further subdivided into regions of hypervariability, termed complementarity determining regions (CDR), interspersed with framework regions (FR). Each VH and VL is composed of three CDRs and four FR segments, arranged from amino-to-carboxy-terminus in the following order: FR1, CDR1, FR2, CDR2, FR3, CDR3 and FR4.

"Genetic modification" refers to the introduction of a "foreign" (i.e., extrinsic or extracellular) gene, DNA or RNA sequence to a host cell, so that the host cell will express the introduced gene or sequence to produce a desired substance, typically a protein or enzyme coded by the introduced gene or sequence. The introduced gene or sequence may also be called a "cloned" or "foreign" gene or sequence, may include regulatory or control sequences operably linked to polynucleotide encoding the chimeric antigen receptor, such as start, stop, promoter, signal, secretion, or other sequences used by a cell's genetic machinery. The gene or sequence may include nonfunctional sequences or sequences with no known function. A host cell that receives and expresses introduced DNA or RNA has been "genetically engineered." The DNA or RNA introduced to a host cell can come from any source, including cells of the same genus or species as the host cell, or from a different genus or species.

"Heterologous" refers to two or more polynucleotides or two or more polypeptides that are not found in the same relationship to each other in nature.

"Heterologous polynucleotide" refers to a non-naturally occurring polynucleotide that encodes two or more neoantigens as described herein.

"Heterologous polypeptide" refers to a non-naturally occurring polypeptide comprising two or more neoantigen polypeptides as described herein.

"Host cell" refers to any cell that contains a heterologous nucleic acid. An exemplary heterologous nucleic acid is a vector (e.g., an expression vector).

"Human antibody" refers to an antibody that is optimized to have minimal immune response when administered to a human subject. Variable regions of human antibody are derived from human immunoglobulin sequences. If human antibody contains a constant region or a portion of the constant region, the constant region is also derived from human immunoglobulin sequences. Human antibody comprises heavy and light chain variable regions that are "derived from" sequences of human origin if the variable regions of the human antibody are obtained from a system that uses human germline immunoglobulin or rearranged immunoglobulin genes. Such exemplary systems are human immunoglobulin gene libraries displayed on phage, and transgenic non-human animals such as mice or rats carrying human immunoglobulin loci. "Human antibody" typically contains amino acid differences when compared to the immunoglobulins expressed in humans due to differences between the systems used to obtain the human antibody and human immunoglobulin loci, introduction of somatic mutations or intentional introduction of substitutions into the frameworks or CDRs, or both. Typically, "human antibody" is at least about 80%, 81%, 82%, 83%, 84%, 85%, 86%, 87%, 88%, 89%, 90%, 91%, 92%, 93%, 94%, 95%, 96%, 97%, 98% or 99% identical in amino acid sequence to an amino acid sequence encoded by human germline immunoglobulin or rearranged immunoglobulin genes. In some cases, "human antibody" may contain consensus framework sequences derived from human framework sequence analyses, for example as described in Knappik et al., (2000) J Mol Biol 296:57-86, or a synthetic HCDR3 incorporated into human immunoglobulin gene libraries displayed on phage, for example as described in Shi et al., (2010) J Mol Biol 397:385-96, and in Int. Patent Publ. No. WO2009/085462. Antibodies in which at least one CDR is derived from a non-human species are not included in the definition of "human antibody".

"Humanized antibody" refers to an antibody in which at least one CDR is derived from non-human species and at least one framework is derived from human immunoglobulin sequences. Humanized antibody may include substitutions in the frameworks so that the frameworks may not be exact copies of expressed human immunoglobulin or human immunoglobulin germline gene sequences.

"In combination with" means that two or more therapeutic agents are be administered to a subject together in a mixture, concurrently as single agents or sequentially as single agents in any order.

"Intracellular signaling domain" or "cytoplasmic signaling domain" refers to an intracellular portion of a molecule. It is the functional portion of the protein which acts by transmitting information within the cell to regulate cellular activity via defined signaling pathways by generating second messengers or functioning as effectors by responding to such messengers. The intracellular signaling domain generates a signal that promotes an immune effector function of the CAR containing cell, e.g., a CAR-T cell.

"Isolated" refers to a homogenous population of molecules (such as synthetic polynucleotides or polypeptides) which have been substantially separated and/or purified away from other components of the system the molecules are produced in, such as a recombinant cell, as well as a protein that has been subjected to at least one purification or isolation step. "Isolated" refers to a molecule that is substantially free of other cellular material and/or chemicals and encompasses molecules that are isolated to a higher purity, such as to 80%, 81%, 82%, 83%, 84%, 85%, 86%, 87%, 88%, 89%, 90%, 91%, 92%, 93%, 94%, 95%, 96%, 97%, 98%, 99% or 100% purity.

"Kallikrein related peptidase 2" or "hK2" refers to a known protein which is also called kallikrein-2, grandular kallikrein 2, or HK2. hK2 is produced as a preproprotein and cleaved during proteolysis to generate active protease. All hK2 isoforms and variants are encompassed in "hK2". The amino acid sequences of the various isoforms are retrievable from GenBank accession numbers NP_005542.1, NP_001002231.1 and NP_001243009. The amino acid sequence of a full length hK2 is shown in SEQ ID NO: 98. The sequence includes the signal peptide (residues 1-18) and the pro-peptide region (residues 19-24).

```
                                     SEQ ID NO: 98
MWDLVLSIALSVGCTGAVPLIQSRIVGGWECEKHSQPWQVAVYSHGWAHC

GGVLVHPQWVLTAAHCLKKNSQVWLGRHNLFEPEDTGQRVPVSHSFPHPL

YNMSLLKHQSLRPDEDSSHDLMLLRLSEPAKITDVVKVLGLPTQEPALGT

TCYASGWGSIEPEEFLRPRSLQCVSLHLLSNDMCARAYSEKVTEFMLCAG

LWTGGKDTCGGDSGGPLVCNGVLQGITSWGPEPCALPEKPAVYTKVVHYR

KWIKDTIAANP
```

"Human leukocyte antigen G" or "HLA-G" refers to a known protein which is also called "HLA class I histocompatibility antigen, alpha chain G" or "MHC class I antigen G". All HLA-G isoforms and variants are encompassed in "HLA-G". The amino acid sequences of the various isoforms are retrievable from Uniprot ID numbers P17693-1 through P17693-7. SEQ ID No: 691 represents an exemplary HLA-G isoform termed HLA-G1.

HLA-G1 (signal sequence: italic), SEQ ID No: 691:
*MVVMAPRTLFLLLSGALTLTETWA*GSHSMRYFSAAVSRPGRGEPRFIAMG

YVDDTQFVRFDSDSACPRMEPRAPWVEQEGPEYWEEETRNTKAHAQTDRM

NLQTLRGYYNQSEASSHTLQWMIGCDLGSDGRLLRGYEQYAYDGKDYLAL

NEDLRSWTAADTAAQISKRKCEAANVAEQRRAYLEGTCVEWLHRYLENGK

EMLQRADPPKTHVTHHPVFDYEATLRCWALGFYPAEIILTWQRDGEDQTQ

DVELVETRPAGDGTFQKWAAVVVPSGEEQRYTCHVQHEGLPEPLMLRWKQ

SSLPTIPIMGIVAGLVVLAAVVTGAAVAAVLWRKKSSD

"Modulate" refers to either enhanced or decreased ability of a test molecule to mediate an enhanced or a reduced response (i.e., downstream effect) when compared to the response mediated by a control or a vehicle.

"Monoclonal antibody" refers to an antibody obtained from a substantially homogenous population of antibody molecules, i.e., the individual antibodies comprising the population are identical except for possible well-known alterations such as removal of C-terminal lysine from the antibody heavy chain or post-translational modifications such as amino acid isomerization or deamidation, methionine oxidation or asparagine or glutamine deamidation. Monoclonal antibodies typically bind one antigenic epitope. A bispecific monoclonal antibody binds two distinct antigenic epitopes. Monoclonal antibodies may have heterogeneous glycosylation within the antibody population. Monoclonal antibody may be monospecific or multispecific such as bispecific, monovalent, bivalent or multivalent.

"Multispecific" refers to a molecule, such as an antibody that specifically binds two or more distinct antigens or two or more distinct epitopes within the same antigen. Multispecific molecule may have cross-reactivity to other related antigens, for example to the same antigen from other species (homologs), such as human or monkey, for example *Macaca fascicularis* (cynomolgus, cyno) or *Pan troglodytes*, or may bind an epitope that is shared between two or more distinct antigens.

"Natural killer cell" and "NK cell" are used interchangeably and synonymously herein. NK cell refers to a differentiated lymphocyte with a $CD16^{+}CD56^{+}$ and/or $CD57^{+}$ $TCR^{-}$ phenotype. NK cells are characterized by their ability to bind to and kill cells that fail to express "self" MHC/HLA antigens by the activation of specific cytolytic enzymes, the ability to kill tumor cells or other diseased cells that express a ligand for NK activating receptors, and the ability to release protein molecules called cytokines that stimulate or inhibit the immune response.

"Operatively linked" and similar phrases, when used in reference to nucleic acids or amino acids, refers to the operational linkage of nucleic acid sequences or amino acid sequence, respectively, placed in functional relationships with each other. For example, an operatively linked promoter, enhancer elements, open reading frame, 5' and 3' UTR, and terminator sequences result in the accurate production of a nucleic acid molecule (e.g., RNA) and in some instances to the production of a polypeptide (i.e., expression of the open reading frame). Operatively linked peptide refers to a peptide in which the functional domains of the peptide are placed with appropriate distance from each other to impart the intended function of each domain.

The term "paratope" refers to the area or region of an antibody molecule which is involved in binding of an antigen and comprise residues that interact with an antigen. A paratope may composed of continuous and/or discontinuous amino acids that form a conformational spatial unit. The paratope for a given antibody can be defined and characterized at different levels of details using a variety of experimental and computational methods. The experimental methods include hydrogen/deuterium exchange mass spectrometry (HX-MS). The paratope will be defined differently depending on the mapping method employed.

"Pharmaceutical combination" refers to a combination of two or more active ingredients administered either together or separately.

"Pharmaceutical composition" refers to a composition that results from combining an active ingredient and a pharmaceutically acceptable carrier.

"Pharmaceutically acceptable carrier" or "excipient" refers to an ingredient in a pharmaceutical composition, other than the active ingredient, which is nontoxic to a subject. Exemplary pharmaceutically acceptable carriers are a buffer, stabilizer or preservative.

"Polynucleotide" or "nucleic acid" refers to a synthetic molecule comprising a chain of nucleotides covalently linked by a sugar-phosphate backbone or other equivalent covalent chemistry. cDNA is a typical example of a polynucleotide. Polynucleotide may be a DNA or a RNA molecule.

"Prevent," "preventing," "prevention," or "prophylaxis" of a disease or disorder means preventing that a disorder occurs in a subject.

"Proliferation" refers to an increase in cell division, either symmetric or asymmetric division of cells.

"Promoter" refers to the minimal sequences required to initiate transcription. Promoter may also include enhancers or repressor elements which enhance or suppress transcription, respectively.

"Protein" or "polypeptide" are used interchangeably herein and refer to a molecule that comprises one or more polypeptides each comprised of at least two amino acid residues linked by a peptide bond. Protein may be a monomer, or may be protein complex of two or more subunits, the subunits being identical or distinct. Small polypeptides of less than 50 amino acids may be referred to as "peptides". Protein may be a heterologous fusion protein, a glycoprotein, or a protein modified by post-translational modifications such as phosphorylation, acetylation, myristoylation, palmitoylation, glycosylation, oxidation, formylation, amidation, citrullination, polyglutamylation, ADP-ribosylation, pegylation or biotinylation. Protein may be an antibody or may comprise an antigen binding fragment of an antibody. Protein may be recombinantly expressed.

"Recombinant" refers to polynucleotides, polypeptides, vectors, viruses and other macromolecules that are prepared, expressed, created or isolated by recombinant means.

"Regulatory element" refers to any cis- or trans acting genetic element that controls some aspect of the expression of nucleic acid sequences.

"Relapsed" refers to the return of a disease or the signs and symptoms of a disease after a period of improvement after prior treatment with a therapeutic.

"Refractory" refers to a disease that does not respond to a treatment. A refractory disease can be resistant to a treatment before or at the beginning of the treatment, or a refractory disease can become resistant during a treatment.

"Single chain Fv" or "scFv" refers to a fusion protein comprising at least one antibody fragment comprising a light chain variable region (VL) and at least one antibody fragment comprising a heavy chain variable region (VH), wherein the VL and the VH are contiguously linked via a polypeptide linker, and capable of being expressed as a single chain polypeptide. Unless specified, as used herein, a scFv may have the VL and VH variable regions in either order, e.g., with respect to the N-terminal and C-terminal ends of the polypeptide, the scFv may comprise VL-linker-VH or may comprise VH-linker-VL.

"$(scFv)_2$" or "tandem scFv" or "bis-scFv" fragments refers to a fusion protein comprising two light chain variable region (VL) and two heavy chain variable region (VH), wherein the two VL and the two VH are contiguously linked via polypeptide linkers, and capable of being expressed as a single chain polypeptide. The two VL and two VH are fused by peptide linkers to form a bivalent molecule $VL_A$-linker-$VH_A$-linker-$VL_B$-linker-$VH_B$ to form two binding sites, capable of binding two different antigens or epitopes concurrently.

"Specifically binds," "specific binding," "specifically binding" or "binds" refer to a proteinaceous molecule binding to an antigen or an epitope within the antigen with greater affinity than for other antigens. Typically, the proteinaceous molecule binds to the antigen or the epitope within the antigen with an equilibrium dissociation constant ($K_D$) of about $1\times10^{-7}$ M or less, for example about $5\times10^{-8}$ M or less, about $1\times10^{-8}$ M or less, about $1\times10^{-9}$ M or less, about $1\times10^{-0}$ M or less, about $1\times10^{-1}$ M or less, or about $1\times10^{-2}$ M or less, typically with the $K_D$ that is at least one hundred fold less than its $K_D$ for binding to a non-specific antigen (e.g., BSA, casein). In the context of the prostate neoantigens described here, "specific binding" refers to binding of the proteinaceous molecule to the prostate neoantigen without detectable binding to a wild-type protein the neoantigen is a variant of.

"Subject" includes any human or nonhuman animal. "Nonhuman animal" includes all vertebrates, e.g., mammals and non-mammals, such as nonhuman primates, sheep, dogs, cats, horses, cows, chickens, amphibians, reptiles, etc. The terms "subject" and "patient" can be used interchangeably herein.

"T cell" and "T lymphocyte" are interchangeable and used synonymously herein. T cell includes thymocytes, naïve T lymphocytes, memory T cells, immature T lymphocytes, mature T lymphocytes, resting T lymphocytes, or activated T lymphocytes. A T cell can be a T helper (Th) cell, for example a T helper 1 (Th1) or a T helper 2 (Th2) cell. The T cell can be a helper T cell (HTL; $CD4^+$ T cell) $CD4^+$ T cell, a cytotoxic T cell (CTL; $CD8^+$ T cell), a tumor infiltrating cytotoxic T cell (TIL; $CD8^+$ T cell), $CD4^+CD8^+$ T cell, or any other subset of T cells. Also included are "NKT cells", which refer to a specialized population of T cells that express a semi-invariant αβ T-cell receptor, but also express a variety of molecular markers that are typically associated with NK cells, such as NK1.1. NKT cells include $NK1.1^+$ and $NK1.1^-$, as well as $CD4^+$, $CD4^-$, $CD8^+$ and $CD8^-$ cells. The TCR on NKT cells is unique in that it recognizes glycolipid antigens presented by the MHC I-like molecule CD Id. NKT cells can have either protective or deleterious effects due to their abilities to produce cytokines that promote either inflammation or immune tolerance. Also included are "gamma-delta T cells (γδ T cells)," which refer to a specialized population that to a small subset of T cells possessing a distinct TCR on their surface, and unlike the majority of T cells in which the TCR is composed of two glycoprotein chains designated α- and β-TCR chains, the TCR in γδ T cells is made up of a γ-chain and a δ-chain. γδ T cells can play a role in immunosurveillance and immunoregulation, and were found to be an important source of IL-17 and to induce robust $CD8^+$ cytotoxic T cell response. Also included are "regulatory T cells" or "Tregs" which refer to T cells that suppress an abnormal or excessive immune response and play a role in immune tolerance. Tregs are typically transcription factor Foxp3-positive $CD4^+$ T cells and can also include transcription factor Foxp3-negative regulatory T cells that are IL-10-producing $CD4^+$ T cells.

"Therapeutically effective amount" or "effective amount" used interchangeably herein, refers to an amount effective, at dosages and for periods of time necessary, to achieve a desired therapeutic result. A therapeutically effective amount may vary according to factors such as the disease state, age, sex, and weight of the individual, and the ability of a therapeutic or a combination of therapeutics to elicit a desired response in the individual. Example indicators of an effective therapeutic or combination of therapeutics that include, for example, improved wellbeing of the patient, reduction of a tumor burden, arrested or slowed growth of a tumor, and/or absence of metastasis of cancer cells to other locations in the body.

"Transduction" refers to the introduction of a foreign nucleic acid into a cell using a viral vector.

"Treat," "treating" or "treatment" of a disease or disorder such as cancer refers to accomplishing one or more of the following: reducing the severity and/or duration of the disorder, inhibiting worsening of symptoms characteristic of the disorder being treated, limiting or preventing recurrence of the disorder in subjects that have previously had the disorder, or limiting or preventing recurrence of symptoms in subjects that were previously symptomatic for the disorder.

"Tumor cell" or a "cancer cell" refers to a cancerous, pre-cancerous or transformed cell, either in vivo, ex vivo, or in tissue culture, that has spontaneous or induced phenotypic changes. These changes do not necessarily involve the uptake of new genetic material. Although transformation may arise from infection with a transforming virus and incorporation of new genomic nucleic acid, uptake of exogenous nucleic acid or it can also arise spontaneously or following exposure to a carcinogen, thereby mutating an endogenous gene. Transformation/cancer is exemplified by morphological changes, immortalization of cells, aberrant growth control, foci formation, proliferation, malignancy, modulation of tumor specific marker levels, invasiveness, tumor growth in suitable animal hosts such as nude mice, and the like, in vitro, in vivo, and ex vivo.

"Variant," "mutant" or "altered" refers to a polypeptide or a polynucleotide that differs from a reference polypeptide or a reference polynucleotide by one or more modifications, for example one or more substitutions, insertions or deletions.

The numbering of amino acid residues in the antibody constant region throughout the specification is according to the EU index as described in Kabat et al., Sequences of Proteins of Immunological Interest, 5th Ed. Public Health Service, National Institutes of Health, Bethesda, MD (1991), unless otherwise explicitly stated.

Mutations in the Ig constant regions are referred to as follows: L351Y_F405A_Y407V refers to L351Y, F405A and Y407V mutations in one immunoglobulin constant region. L351Y_F405A_Y407V/T394W refers to L351Y, F405A and Y407V mutations in the first Ig constant region and T394W mutation in the second Ig constant region, which are present in one multimeric protein.

"VHH" refers to a single-domain antibody or nanobody, exclusively composed by heavy chain homodimers A VHH single domain antibody lack the light chain and the CH1 domain of the heavy chain of conventional Fab region.

Unless otherwise stated, any numerical values, such as a concentration or a concentration range described herein, are to be understood as being modified in all instances by the term "about." Thus, a numerical value typically includes ±10% of the recited value. For example, a concentration of 1 mg/mL includes 0.9 mg/mL to 1.1 mg/mL. Likewise, a concentration range of 1% to 10% (w/v) includes 0.9% (w/v) to 11% (w/v). As used herein, the use of a numerical range expressly includes all possible subranges, all individual numerical values within that range, including integers within such ranges and fractions of the values unless the context clearly indicates otherwise.

The numbering of amino acid residues in the antibody constant region throughout the specification is according to the EU index as described in Kabat et al., Sequences of Proteins of Immunological Interest, 5th Ed. Public Health Service, National Institutes of Health, Bethesda, MD (1991), unless otherwise explicitly stated.

TABLE 1

Conventional one- and three-letter amino acid codes used herein

| Amino acid | Three-letter code | One-letter code |
|---|---|---|
| Alanine | Ala | A |
| Arginine | Arg | R |
| Asparagine | Asn | N |
| Aspartate | Asp | D |
| Cysteine | Cys | C |
| Glutamate | Glu | E |
| Glutamine | Gln | Q |
| Glycine | Gly | G |
| Histidine | His | H |
| Isoleucine | Ile | I |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

Antigen Binding Domains that Bind CD3ε.

The disclosure provides antigen binding domains that bind CD3ε, monospecific and multispecific proteins comprising the antigen binding domains that bind CD3ε, polynucleotides encoding the foregoing, vectors, host cells and methods of making and using the foregoing. The antigen binding domains that bind CD3ε identified herein demonstrated advantageous properties in terms of high thermostability, reduced deamidation risk, and decreased immunogenicity.

The disclosure also provides an isolated protein comprising an antigen binding domain that binds CD3ε, wherein the antigen binding domain that binds CD3ε comprises a heavy chain variable region (VH) of SEQ ID NO: 23 and a light chain variable region (VL) of SEQ ID NO: 103. SEQ ID NO: 103 represent genus VL amino acid sequences encompassing variants demonstrating improved properties, including high thermostability, reduced deamidation risk, and decreased immunogenicity. For example, the position engineered to confer reduced deamidation risk was residue N92 in the VL (residue numbering using the CD3B815 VL sequence of SEQ ID NO: 24, according to Kabat numbering (Kabat et al., Sequences of Proteins of Immunological Interest, 5th Ed. Public Health Service, National Institutes of Health, Bethesda, Md., 1991)) and the positions engineered to confer decreased immunogenicity were human to mouse back mutations at residues Y49 and/or L78 (residue numbering according to Kabat, using the CD3B815 VL of SEQ ID NO: 24). The engineered position at residue N92 was within LCDR3. Even with mutations at this position, antibodies retained the ability to bind antigen.

The disclosure provides an isolated protein comprising an antigen binding domain that binds CD3ε, wherein the antigen binding domain that binds CD3ε comprises a heavy chain complementarity determining region (HCDR) 1, a HCDR2 and a HCDR3 of a heavy chain variable region (VH) of SEQ ID NO: 23 and a light chain complementarity determining region (LCDR) 1, a LCDR2 and a LCDR3 of a light chain variable region (VL) of SEQ ID NO: 24.

The disclosure provides an isolated protein comprising an antigen binding domain that binds CD3ε, wherein the antigen binding domain that binds CD3ε comprises the HCDR1, the HCDR1, the HCDR3, the LCDR1, the LCDR2 and the LCDR3 of SEQ ID NOs: 6, 7, 8, 9, 10, and 11, respectively;

SEQ ID NOs: 12, 13, 14, 15, 16, and 17, respectively; or

SEQ ID NOs: 18, 19, 20, 21, 16, and 22, respectively.

The disclosure provides an isolated protein comprising an antigen binding domain that binds CD3ε, wherein the antigen binding domain that binds CD3ε comprises the VH of SEQ ID NOs: 23 and the VL of SEQ ID NOs: 24, 27, 28, 29 or 30.

The disclosure provides an isolated protein comprising an antigen binding domain that binds CD3ε, wherein the antigen binding domain that binds CD3ε comprises the VH of SEQ ID NO: 23 and the VL of SEQ ID NO: 24;

the VH of SEQ ID NO: 23 and the VL of SEQ ID NO: 27;

the VH of SEQ ID NO: 23 and the VL of SEQ ID NO: 28;

the VH of SEQ ID NO: 23 and the VL of SEQ ID NO: 29; or the VH of SEQ ID NO: 23 and the VL of SEQ ID NO: 30.

The disclosure provides an isolated protein comprising an antigen binding domain that binds CD3ε, wherein the antigen binding domain that binds CD3ε comprises the amino acid sequence of SEQ ID NOs: 25 or 26. In other embodiments, the antigen binding domain that binds CD3ε comprises the amino acid sequence of SEQ ID NOs: 85 or 86. In other embodiments, the antigen binding domain that binds CD3ε comprises the amino acid sequence of SEQ ID NOs: 85 or 88. In other embodiments, the antigen binding domain that binds CD3ε comprises the amino acid sequence of SEQ ID NOs: 85 or 90. In other embodiments, the antigen binding domain that binds CD3ε comprises the amino acid sequence of SEQ ID NOs: 85 or 92. In other embodiments, the antigen binding domain that binds CD3ε comprises the amino acid sequence of SEQ ID NOs: 85 or 94.

In other embodiments, the antigen binding domain that binds CD3ε is a scFv.

In other embodiments, the antigen binding domain that binds CD3ε is a $(scFv)_2$.

In other embodiments, the antigen binding domain that binds CD3ε is a Fv.

In other embodiments, the antigen binding domain that binds CD3ε is a Fab.

In other embodiments, the antigen binding domain that binds CD3ε is a $F(ab')_2$.

In other embodiments, the antigen binding domain that binds CD3ε is a Fd.

In other embodiments, the CD3ε antigen binding domain is a dAb.

In other embodiments, the CD3ε antigen binding domain is a VHH.

CD3ε Binding scFvs

Any of the VH and the VL domains identified herein that bind CD3ε may be engineered into scFv format in either VH-linker-VL or VL-linker-VH orientation. Any of the VH and the VL domains identified herein may also be used to generate $sc(Fv)_2$ structures, such as VH-linker-VL-linker-VL-linker-VH, VH-linker-VL-linker-VH-linker-VL. VH-linker-VH-linker-VL-linker-VL. VL-linker-VH-linker-VH-linker-VL. VL-linker-VH-linker-VL-linker-VH or VL-linker-VL-linker-VH-linker-VH.

The VH and the VL domains identified herein may be incorporated into a scFv format and the binding and thermostability of the resulting scFv to CD3ε may be assessed using known methods. Binding may be assessed using ProteOn XPR36, Biacore® 3000 or KinExA instrumentations, ELISA or competitive binding assays known to those skilled in the art. Binding may be evaluated using purified scFvs or *E. coli* supernatants or lysed cells containing the expressed scFv. The measured affinity of a test scFv to CD3ε may vary if measured under different conditions (e.g., osmolarity, pH). Thus, measurements of affinity and other binding parameters (e.g., KD, Kon, Koff) are typically made with standardized conditions and standardized buffers. Thermostability may be evaluated by heating the test scFv at elevated temperatures, such as 50° C., 55° C. or 60° C. for a period of time, such as 5 minutes (min), 10 min, 15 min, 20 min, 25 min or 30 min and measuring binding of the test scFv to CD3ε. The scFvs retaining comparable binding to CD3ε when compared to a non-heated scFv sample are referred to as being thermostable.

In recombinant expression systems, the linker is a peptide linker and may include any naturally occurring amino acid. Exemplary amino acids that may be included into the linker are Gly, Ser Pro, Thr, Glu, Lys, Arg, Ile, Leu, His and The. The linker should have a length that is adequate to link the VH and the VL in such a way that they form the correct conformation relative to one another so that they retain the desired activity, such as binding to CD3ε.

The linker may be about 5-50 amino acids long. In other embodiments, the linker is about 10-40 amino acids long. In other embodiments, the linker is about 10-35 amino acids long. In other embodiments, the linker is about 10-30 amino acids long. In other embodiments, the linker is about 10-25 amino acids long. In other embodiments, the linker is about 10-20 amino acids long. In other embodiments, the linker is about 15-20 amino acids long. In other embodiments, the linker is about 16-19 amino acids long. In other embodiments, the linker is 6 amino acids long. In other embodiments, the linker is 7 amino acids long. In other embodiments, the linker is 8 amino acids long. In other embodiments, the linker is 9 amino acids long. In other embodiments, the linker is 10 amino acids long. In other embodiments, the linker is 11 amino acids long. In other embodiments, the linker is 12 amino acids long. In other embodiments, the linker is 13 amino acids long. In other embodiments, the linker is 14 amino acids long. In other embodiments, the linker is 15 amino acids long. In other embodiments, the linker is 16 amino acids long. In other embodiments, the linker is 17 amino acids long. In other embodiments, the linker is 18 amino acids long. In other embodiments, the linker is 19 amino acids long. In other embodiments, the linker is 20 amino acids long. In other embodiments, the linker is 21 amino acids long. In other embodiments, the linker is 22 amino acids long. In other embodiments, the linker is 23 amino acids long. In other embodiments, the linker is 24 amino acids long. In other embodiments, the linker is 25 amino acids long. In other embodiments, the linker is 26 amino acids long. In other embodiments, the linker is 27 amino acids long. In other embodiments, the linker is 28 amino acids long. In other embodiments, the linker is 29 amino acids long. In other embodiments, the linker is 30 amino acids long. In other embodiments, the linker is 31 amino acids long. In other embodiments, the linker is 32 amino acids long. In other embodiments, the linker is 33 amino acids long. In other embodiments, the linker is 34 amino acids long. In other embodiments, the linker is 35 amino acids long. In other embodiments, the linker is 36 amino acids long. In other embodiments, the linker is 37 amino acids long. In other embodiments, the linker is 38 amino acids long. In other embodiments, the linker is 39 amino acids long. In other embodiments, the linker is 40 amino acids long. Exemplary linkers that may be used are Gly rich linkers, Gly and Ser containing linkers, Gly and Ala containing linkers, Ala and Ser containing linkers, and other flexible linkers.

Other linker sequences may include portions of immunoglobulin hinge area, CL or CH1 derived from any immunoglobulin heavy or light chain isotype. Alternatively, a variety of non-proteinaceous polymers, including polyethylene glycol (PEG), polypropylene glycol, polyoxyalkylenes, or copolymers of polyethylene glycol and polypropylene glycol, may find use as linkers. Exemplary linkers that may be used are shown in Table 2. Additional linkers are described for example in Int. Pat. Publ. No. WO2019/060695.

TABLE 2

Linkers.

| Linker name | Amino acid sequence | SEQ ID NO: |
|---|---|---|
| Linker 1 | GGSEGKSSGSGSESKSTGGS | 31 |
| Linker 2 | GGGSGGGS | 32 |
| Linker 3 | GGGSGGGSGGGS | 33 |
| Linker 4 | GGGSGGGSGGGSGGGS | 34 |
| Linker 5 | GGGSGGGSGGGSGGGSGGGS | 35 |
| Linker 6 | GGGGSGGGGSGGGGS | 36 |
| Linker 7 | GGGGSGGGGSGGGGSGGGGS | 37 |
| Linker 8 | GGGGSGGGGSGGGGSGGGGSGGGGS | 38 |
| Linker 9 | GSTSGSGKPGSGEGSTKG | 39 |
| Linker 10 | IRPRAIGGSKPRVA | 40 |
| Linker 11 | GKGGSGKGGSGKGGS | 41 |
| Linker 12 | GGKGSGGKGSGGKGS | 42 |
| Linker 13 | GGGKSGGGKSGGGKS | 43 |
| Linker 14 | GKGKSGKGKSGKGKS | 44 |
| Linker 15 | GGGKSGGKGSGKGGS | 45 |
| Linker 16 | GKPGSGKPGSGKPGS | 46 |
| Linker 17 | GKPGSGKPGSGKPGSGKPGS | 47 |
| Linker 18 | GKGKSGKGKSGKGKSGKGKS | 48 |
| Linker 19 | STAGDTHLGGEDFD | 49 |
| Linker 20 | GEGGSGEGGSGEGGS | 50 |
| Linker 21 | GGEGSGGEGSGGEGS | 51 |
| Linker 22 | GEGESGEGESGEGES | 52 |
| Linker 23 | GGGESGGEGSGEGGS | 53 |
| Linker 24 | GEGESGEGESGEGESGEGES | 54 |
| Linker 25 | GSTSGSGKPGSGEGSTKG | 55 |
| Linker 26 | PRGASKSGSASQTGSAPGS | 56 |
| Linker 27 | GTAAAGAGAAGGAAAGAAG | 57 |
| Linker 28 | GTSGSSGSGSGGSGSGGGG | 58 |

TABLE 2-continued

Linkers.

| Linker name | Amino acid sequence | SEQ ID NO: |
|---|---|---|
| Linker 29 | GKPGSGKPGSGKPGSGKPGS | 59 |
| Linker 30 | GSGS | 60 |
| Linker 31 | APAPAPAPAP | 61 |
| Linker 32 | APAPAPAPAPAPAPAPAPAP | 62 |
| Linker 33 | AEAAAKEAAAKEAAAAKEAAAAKEAAAA KAAA | 63 |
| Linker 34 | GTEGKSSGSGSESKST | 64 |

In other embodiments, the scFv comprises, from the N- to C-terminus, a VH, a first linker (L1) and a VL (VH-L1-VL).

In other embodiments, the scFv comprises, from the N- to C-terminus, the VL, the L1 and the VH (VL-L1-VH).

In other embodiments, the L1 comprises the amino acid sequence of SEQ ID NO: 31.

In other embodiments, the L1 comprises the amino acid sequence of SEQ ID NO: 32.

In other embodiments, the L1 comprises the amino acid sequence of SEQ ID NO: 33.

In other embodiments, the L1 comprises the amino acid sequence of SEQ ID NO: 34.

In other embodiments, the L1 comprises the amino acid sequence of SEQ ID NO: 35.

In other embodiments, the L1 comprises the amino acid sequence of SEQ ID NO: 36.

In other embodiments, the L1 comprises the amino acid sequence of SEQ ID NO: 37.

In other embodiments, the L1 comprises the amino acid sequence of SEQ ID NO: 38.

In other embodiments, the L1 comprises the amino acid sequence of SEQ ID NO: 39.

In other embodiments, the L1 comprises the amino acid sequence of SEQ ID NO: 40.

In other embodiments, the L1 comprises the amino acid sequence of SEQ ID NO: 41.

In other embodiments, the L1 comprises the amino acid sequence of SEQ ID NO: 42.

In other embodiments, the L1 comprises the amino acid sequence of SEQ ID NO: 43.

In other embodiments, the L1 comprises the amino acid sequence of SEQ ID NO: 44.

In other embodiments, the L1 comprises the amino acid sequence of SEQ ID NO: 45.

In other embodiments, the L1 comprises the amino acid sequence of SEQ ID NO: 46.

In other embodiments, the L1 comprises the amino acid sequence of SEQ ID NO: 47.

In other embodiments, the L1 comprises the amino acid sequence of SEQ ID NO: 48.

In other embodiments, the L1 comprises the amino acid sequence of SEQ ID NO: 49.

In other embodiments, the L1 comprises the amino acid sequence of SEQ ID NO: 50.

In other embodiments, the L1 comprises the amino acid sequence of SEQ ID NO: 51.

In other embodiments, the L1 comprises the amino acid sequence of SEQ ID NO: 52.

In other embodiments, the L1 comprises the amino acid sequence of SEQ ID NO: 53.

In other embodiments, the L1 comprises the amino acid sequence of SEQ ID NO: 54.

In other embodiments, the L1 comprises the amino acid sequence of SEQ ID NO: 55.

In other embodiments, the L1 comprises the amino acid sequence of SEQ ID NO: 56.

In other embodiments, the L1 comprises the amino acid sequence of SEQ ID NO: 57.

In other embodiments, the L1 comprises the amino acid sequence of SEQ ID NO: 58.

In other embodiments, the L1 comprises the amino acid sequence of SEQ ID NO: 59.

In other embodiments, the L1 comprises the amino acid sequence of SEQ ID NO: 60.

In other embodiments, the L1 comprises the amino acid sequence of SEQ ID NO: 61.

In other embodiments, the L1 comprises the amino acid sequence of SEQ ID NO: 62.

In other embodiments, the L1 comprises the amino acid sequence of SEQ ID NO: 63.

In other embodiments, the L1 comprises the amino acid sequence of SEQ ID NO: 64.

In other embodiments, the scFv comprises a heavy chain complementarity determining region (HCDR) 1, a HCDR2 and a HCDR3 of a heavy chain variable region (VH) of SEQ ID NO: 23 and a light chain complementarity determining region (LCDR) 1, a LCDR2 and a LCDR3 of a light chain variable region (VL) of SEQ ID NO: 24.

In other embodiments, the scFv comprises the HCDR1, the HCDR1, the HCDR3, the LCDR1, the LCDR2 and the LCDR3 of SEQ ID NOs: 6, 7, 8, 9, 10, and 11, respectively; or SEQ ID NOs: 12, 13, 14, 15, 16, and 17, respectively; or SEQ ID NOs: 18, 19, 20, 21, 16, and 22, respectively.

In other embodiments, the scFv comprises the HCDR1, the HCDR1, the HCDR3, the LCDR1, the LCDR2 and the LCDR3 of SEQ ID NOs: 6, 7, 8, 9, 10, and 11, respectively.

In other embodiments, the scFv comprises the HCDR1, the HCDR1, the HCDR3, the LCDR1, the LCDR2 and the LCDR3 of SEQ ID NOs: 12, 13, 14, 15, 16, and 17, respectively.

In other embodiments, the scFv comprises the HCDR1, the HCDR1, the HCDR3, the LCDR1, the LCDR2 and the LCDR3 of SEQ ID NOs: 18, 19, 20, 21, 16, and 22, respectively.

In other embodiments, the scFv comprises the VH of SEQ ID NO: 23 and the VL of SEQ ID NO: 24.

In other embodiments, the scFv comprises the VH of SEQ ID NO: 23 and the VL of SEQ ID NO: 27.

In other embodiments, the scFv comprises the VH of SEQ ID NO: 23 and the VL of SEQ ID NO: 28.

In other embodiments, the scFv comprises the VH of SEQ ID NO: 23 and the VL of SEQ ID NO: 29.

In other embodiments, the scFv comprises the VH of SEQ ID NO: 23 and the VL of SEQ ID NO: 30.

In other embodiments, the scFv comprises the amino acid sequence of SEQ ID NOs: 65, 66, 67, 68, 69, 70, 71, 72, 73, or 74.

In other embodiments, the scFv comprises the amino acid sequence of SEQ ID NO: 65.

In other embodiments, the scFv comprises the amino acid sequence of SEQ ID NO: 66.

In other embodiments, the scFv comprises the amino acid sequence of SEQ ID NO: 67.

In other embodiments, the scFv comprises the amino acid sequence of SEQ ID NO: 68.

In other embodiments, the scFv comprises the amino acid sequence of SEQ ID NO: 69.

In other embodiments, the scFv comprises the amino acid sequence of SEQ ID NO: 70.

In other embodiments, the scFv comprises the amino acid sequence of SEQ ID NO: 71.

In other embodiments, the scFv comprises the amino acid sequence of SEQ ID NO: 72.

In other embodiments, the scFv comprises the amino acid sequence of SEQ ID NO: 73.

In other embodiments, the scFv comprises the amino acid sequence of SEQ ID NO: 74.

Other Antigen Binding Domains that Bind CD3ε

Any of the VH and the VL domains identified herein that bind CD3ε may also be engineered into Fab, F(ab')2, Fd or Fv format and their binding to CD3ε and thermostability may be assessed using the assays described herein.

In other embodiments, the Fab comprises a heavy chain complementarity determining region (HCDR) 1, a HCDR2 and a HCDR3 of a heavy chain variable region (VH) of SEQ ID NO: 23 and a light chain complementarity determining region (LCDR) 1, a LCDR2 and a LCDR3 of a light chain variable region (VL) of SEQ ID NO: 24.

In other embodiments, the Fab comprises the HCDR1, the HCDR1, the HCDR3, the LCDR1, the LCDR2 and the LCDR3 of SEQ ID NOs: 6, 7, 8, 9, 10, and 11, respectively;

SEQ ID NOs: 12, 13, 14, 15, 16, and 17, respectively; or

SEQ ID NOs: 18, 19, 20, 21, 16 and 22, respectively.

In other embodiments, the Fab comprises the HCDR1, the HCDR1, the HCDR3, the LCDR1, the LCDR2 and the LCDR3 of SEQ ID NOs: 6, 7, 8, 9, 10, and 11, respectively.

In other embodiments, the Fab comprises the HCDR1, the HCDR1, the HCDR3, the LCDR1, the LCDR2 and the LCDR3 of SEQ ID NOs: 12, 13, 14, 15, 16, and 17, respectively.

In other embodiments, the Fab comprises the HCDR1, the HCDR1, the HCDR3, the LCDR1, the LCDR2 and the LCDR3 of SEQ ID NOs: 18, 19, 20, 21, 16 and 22, respectively.

In other embodiments, the Fab comprises the VH of SEQ ID NO: 23 and the VL of SEQ ID NO: 24.

In other embodiments, the Fab comprises the VH of SEQ ID NO: 23 and the VL of SEQ ID NO: 27.

In other embodiments, the Fab comprises the VH of SEQ ID NO: 23 and the VL of SEQ ID NO: 28.

In other embodiments, the Fab comprises the VH of SEQ ID NO: 23 and the VL of SEQ ID NO: 29.

In other embodiments, the Fab comprises the VH of SEQ ID NO: 23 and the VL of SEQ ID NO: 30.

In other embodiments, the Fab comprises the VH of SEQ ID NO: 23 and the VL of SEQ ID NOs: 24, 27, 28, 29 or 30.

In other embodiments, the $F(ab')_2$ comprises a heavy chain complementarity determining region (HCDR) 1, a HCDR2 and a HCDR3 of a heavy chain variable region (VH) of SEQ ID NO: 23 and a light chain complementarity determining region (LCDR) 1, a LCDR2 and a LCDR3 of a light chain variable region (VL) of SEQ ID NO: 24.

In other embodiments, the $F(ab')_2$ comprises the HCDR1, the HCDR1, the HCDR3, the LCDR1, the LCDR2 and the LCDR3 of SEQ ID NOs: 6, 7, 8, 9, 10, and 11, respectively;
SEQ ID NOs: 12, 13, 14, 15, 16, and 17, respectively; or
SEQ ID NOs: 18, 19, 20, 21, 16 and 22, respectively.

In other embodiments, the $F(ab')_2$ comprises the HCDR1, the HCDR1, the HCDR3, the LCDR1, the LCDR2 and the LCDR3 of SEQ ID NOs: 6, 7, 8, 9, 10, and 11, respectively.

In other embodiments, the $F(ab')_2$ comprises the HCDR1, the HCDR1, the HCDR3, the LCDR1, the LCDR2 and the LCDR3 of SEQ ID NOs: 12, 13, 14, 15, 16, and 17, respectively.

In other embodiments, the $F(ab')_2$ comprises the HCDR1, the HCDR1, the HCDR3, the LCDR1, the LCDR2 and the LCDR3 of SEQ ID NOs: 18, 19, 20, 21, 16 and 22, respectively.

In other embodiments, the $F(ab')_2$ comprises the VH of SEQ ID NO: 23 and the VL of SEQ ID NO: 24.

In other embodiments, the $F(ab')_2$ comprises the VH of SEQ ID NO: 23 and the VL of SEQ ID NO: 27.

In other embodiments, the $F(ab')_2$ comprises the VH of SEQ ID NO: 23 and the VL of SEQ ID NO: 28.

In other embodiments, the $F(ab')_2$ comprises the VH of SEQ ID NO: 23 and the VL of SEQ ID NO: 29.

In other embodiments, the $F(ab')_2$ comprises the VH of SEQ ID NO: 23 and the VL of SEQ ID NO: 30.

In other embodiments, the $F(ab')_2$ comprises the VH of SEQ ID NO: 23 and the VL of SEQ ID NOs: 24, 27, 28, 29 or 30.

In other embodiments, the Fv comprises a heavy chain complementarity determining region (HCDR) 1, a HCDR2 and a HCDR3 of a heavy chain variable region (VH) of SEQ ID NO: 23 and a light chain complementarity determining region (LCDR) 1, a LCDR2 and a LCDR3 of a light chain variable region (VL) of SEQ ID NO: 24.

In other embodiments, the Fv comprises the HCDR1, the HCDR1, the HCDR3, the LCDR1, the LCDR2 and the LCDR3 of SEQ ID NOs: 6, 7, 8, 9, 10, and 11, respectively;
SEQ ID NOs: 12, 13, 14, 15, 16, and 17, respectively; or
SEQ ID NOs: 18, 19, 20, 21, 16 and 22, respectively.

In other embodiments, the Fv comprises the HCDR1, the HCDR1, the HCDR3, the LCDR1, the LCDR2 and the LCDR3 of SEQ ID NOs: 6, 7, 8, 9, 10, and 11, respectively.

In other embodiments, the Fv comprises the HCDR1, the HCDR1, the HCDR3, the LCDR1, the LCDR2 and the LCDR3 of SEQ ID NOs: 12, 13, 14, 15, 16, and 17, respectively.

In other embodiments, the Fv comprises the HCDR1, the HCDR1, the HCDR3, the LCDR1, the LCDR2 and the LCDR3 of SEQ ID NOs: 18, 19, 20, 21, 16 and 22, respectively.

In other embodiments, the Fv comprises the VH of SEQ ID NO: 23 and the VL of SEQ ID NO: 24.

In other embodiments, the Fv comprises the VH of SEQ ID NO: 23 and the VL of SEQ ID NO: 27.

In other embodiments, the Fv comprises the VH of SEQ ID NO: 23 and the VL of SEQ ID NO: 28.

In other embodiments, the Fv comprises the VH of SEQ ID NO: 23 and the VL of SEQ ID NO: 29.

In other embodiments, the Fv comprises the VH of SEQ ID NO: 23 and the VL of SEQ ID NO: 30.

In other embodiments, the Fv comprises the VH of SEQ ID NO: 23 and the VL of SEQ ID NOs: 24, 27, 28, 29 or 30.

In other embodiments, the Fd comprises a heavy chain complementarity determining region (HCDR) 1, a HCDR2 and a HCDR3 of a heavy chain variable region (VH) of SEQ ID NO: 23.

In other embodiments, the Fd comprises the HCDR1, the HCDR1, and the HCDR3 of SEQ ID NOs: 6, 7, and 8, respectively.

In other embodiments, the Fd comprises the HCDR1, the HCDR1, and the HCDR3 of SEQ ID NOs: 12, 13, and 14, respectively.

In other embodiments, the Fd comprises the HCDR1, the HCDR1, and the HCDR3 of SEQ ID NOs: 18, 19, and 20, respectively.

In other embodiments, the Fd comprises the VH of SEQ ID NO: 23.

Homologous Antigen Binding Domains and Antigen Binding Domains with Conservative Substitutions Variants of the antigen binding domains that bind CD3ε are within the scope of the disclosure. For example, variants may comprise 1, 2, 3, 4, 5, 6, 7, 8, 9, 10, 11, 12, 13, 14, 15, 16, 17, 18, 19, 20, 21, 22, 23, 24, 25, 26, 27, 28 or 29 amino acid substitutions in the antigen binding domain that bind CD3ε as long as they retain or have improved functional properties when compared to the parent antigen binding domains. In other embodiments, the sequence identity may be about 80%, 81%, 82%, 83%, 84%, 85%, 86%, 87%, 88%, 89%, 90%, 91%, 92%, 93%, 94%, 95%, 96%, 97%, 98% or 99% to the antigen binding domains that bind CD3ε of the disclosure. In other embodiments, the variation is in the framework regions. In other embodiments, variants are generated by conservative substitutions.

For example, the antigen binding domains that bind CD3ε may comprise substitutions at residue positions Y49, L78, or N92 in the VL (residue numbering according Kabat). Conservative substitutions may be made at any indicated positions and the resulting variant antigen binding domains that bind CD3ε are tested for their desired characteristics in the assays described herein.

Also provided are antigen binding domains that bind CD3ε comprising the VH and the VL which are at least 80% identical to the VH of SEQ ID NO: 23 and the VL of SEQ ID NO: 24;
the VH of SEQ ID NO: 23 and the VL of SEQ ID NO: 27;
the VH of SEQ ID NO: 23 and the VL of SEQ ID NO: 28;
the VH of SEQ ID NO: 23 and the VL of SEQ ID NO: 29; or
the VH of SEQ ID NO: 23 and the VL of SEQ ID NO: 30.

In other embodiments, the identity is 85%. In other embodiments, the identity is 90%. In other embodiments, the identity is 91%. In other embodiments, the identity is 91%. In other embodiments, the identity is 92%. In other embodiments, the identity is 93%. In other embodiments, the identity is 94%. In other embodiments, the identity is 94%. In other embodiments, the identity is 95%. In other embodiments, the identity is 96%. In other embodiments, the identity is 97%. In other embodiments, the identity is 98%. In other embodiments, the identity is 99%.

The percent identity between the two sequences is a function of the number of identical positions shared by the sequences (i.e., % identity=number of identical positions/total number of positions×100), taking into account the number of gaps, and the length of each gap, which need to be introduced for optimal alignment of the two sequences.

The percent identity between two amino acid sequences may be determined using the algorithm of E. Meyers and W. Miller (*Comput Appl Biosci* 4:11-17 (1988)) which has been incorporated into the ALIGN program (version 2.0), using a PAM120 weight residue table, a gap length penalty of 12 and a gap penalty of 4. In addition, the precent identity between two amino acid sequences may be determined using the Needleman and Wunsch (*J Mol Biol* 48:444-453 (1970))

algorithm which has been incorporated into the GAP program in the GCG software package (can be retrieved from the Internet, using either a Blossum 62 matrix or a PAM250 matrix, and a cap weight of 16, 14, 12, 10, 8, 6, or 4 and a length weight of 1, 2, 3, 4, 5, or 6.

In other embodiments, variant antigen binding domains that bind CD3ε comprise one or two conservative substitutions in any of the CDR regions, while retaining desired functional properties of the parent antigen binding fragments that bind CD3ε.

"Conservative modifications" refer to amino acid modifications that do not significantly affect or alter the binding characteristics of the antibody containing the amino acid modifications. Conservative modifications include amino acid substitutions, additions, and deletions. Conservative amino acid substitutions are those in which the amino acid is replaced with an amino acid residue having a similar side chain. The families of amino acid residues having similar side chains (e.g., aspartic acid, glutamic acid), basic side chains (e.g., lysine, arginine, histidine), nonpolar side chains (e.g., alanine, valine, leucine, isoleucine, proline, phenylalanine, methionine), uncharged polar side chains (e.g., glycine, asparagine, glutamine, cysteine, serine, threonine, tyrosine, tryptophan), aromatic side chains, (e.g., phenylalanine, tryptophan, histidine, tyrosine), aliphatic side chains (e.g., glycine, alanine, valine, leucine, isoleucine, serine, threonine), amide (e.g., asparagine, glutamine), beta branched side chains (e.g., threonine, valine, isoleucine) and sulfur-containing side chains (cysteine, methionine). Furthermore, any native residue in the polypeptide may also be substituted with alanine, as has been previously described for alanine scanning mutagenesis (MacLennan et al., (1998) *Acta Physiol Scand Suppl* 643:55-67; Sasaki et al., (1998) *Adv Biophys* 35:1-24). Amino acid substitutions to the antibodies of the invention may be made by known methods for example by PCR mutagenesis (U.S. Pat. No. 4,683,195). Alternatively, libraries of variants may be generated for example using random (NNK) or non-random codons, for example DVK codons, which encode 11 amino acids (Ala, Cys, Asp, Glu, Gly, Lys, Asn, Arg, Ser, Tyr, Trp). The resulting variants may be tested for their characteristics using assays described herein.

Methods of Generating Antigen Binding Fragment that Bind CD3ε

Antigen binding domains that bind CD3ε provided in the disclosure may be generated using various technologies. For example, the hybridoma method of Kohler and Milstein may be used to identify VH/VL pairs that bind CD3ε. In the hybridoma method, a mouse or other host animal, such as a hamster, rat or chicken is immunized with human and/or cyno CD3ε, followed by fusion of spleen cells from immunized animals with myeloma cells using standard methods to form hybridoma cells. Colonies arising from single immortalized hybridoma cells may be screened for production of the antibodies containing the antigen binding domains that bind CD3ε with desired properties, such as specificity of binding, cross-reactivity or lack thereof, affinity for the antigen, and any desired functionality.

Antigen binding domains that bind CD3ε generated by immunizing non-human animals may be humanized. Exemplary humanization techniques including selection of human acceptor frameworks include CDR grafting (U.S. Pat. No. 5,225,539), SDR grafting (U.S. Pat. No. 6,818,749), Resurfacing (Padlan, (1991) *Mol Immunol* 28:489-499), Specificity Determining Residues Resurfacing (U.S. Patent Publ. No. 2010/0261620), human framework adaptation (U.S. Pat. No. 8,748,356) or superhumanization (U.S. Pat. No. 7,709,226). In these methods, CDRs or a subset of CDR residues of parental antibodies are transferred onto human frameworks that may be selected based on their overall homology to the parental frameworks, based on similarity in CDR length, or canonical structure identity, or a combination thereof.

Humanized antigen biding domains may be further optimized to improve their selectivity or affinity to a desired antigen by incorporating altered framework support residues to preserve binding affinity (backmutations) by techniques such as those described in Int. Patent Publ. Nos. WO1090/007861 and WO1992/22653, or by introducing variation at any of the CDRs for example to improve affinity of the antigen binding domain.

Transgenic animals, such as mice, rat or chicken carrying human immunoglobulin (Ig) loci in their genome may be used to generate antigen binding fragments that bind CD3ε, and are described in for example U.S. Pat. No. 6,150,584, Int. Patent Publ. No. WO1999/45962, Int. Patent Publ. Nos. WO2002/066630, WO2002/43478, and WO1990/04036. The endogenous immunoglobulin loci in such animal may be disrupted or deleted, and at least one complete or partial human immunoglobulin locus may be inserted into the genome of the animal using homologous or non-homologous recombination, using transchromosomes, or using minigenes. Companies such as Regeneron, Harbour Antibodies, Open Monoclonal Technology, Inc. (OMT), KyMab, Trianni, and Ablexis® may be engaged to provide human antibodies directed against a selected antigen using technologies as described above.

Antigen binding domains that bind CD3ε may be selected from a phage display library, where the phage is engineered to express human immunoglobulins or portions thereof such as Fabs, single chain antibodies (scFv), or unpaired or paired antibody variable regions. The antigen binding domains that bind CD3ε may be isolated for example from phage display library expressing antibody heavy and light chain variable regions as fusion proteins with bacteriophage pIX coat protein as described in Shi et al., (2010) *J Mol Biol* 397:385-96, and Int. Patent Publ. No. WO09/085462). The libraries may be screened for phage binding to human and/or cyno CD3ε and the obtained positive clones may be further characterized, the Fabs isolated from the clone lysates, and converted to scFvs or other configurations of antigen binding fragments.

Preparation of immunogenic antigens and expression and production of antigen binding domains of the disclosure may be performed using any suitable technique, such as recombinant protein production. The immunogenic antigens may be administered to an animal in the form of purified protein, or protein mixtures including whole cells or cell or tissue extracts, or the antigen may be formed de novo in the animal's body from nucleic acids encoding said antigen or a portion thereof.

Conjugation to Half-Life Extending Moieties

The antigen binding domains that bind CD3ε of the disclosure may be conjugated to a half-life extending moiety. Exemplary half-life extending moieties are albumin, albumin variants, albumin-binding proteins and/or domains, transferrin and fragments and analogues thereof, immunoglobulins (Ig) or fragments thereof, such as Fc regions. Amino acid sequences of the aforementioned half-life extending moieties are known. Ig or fragments thereof include all isotypes (i.e., IgG1, IgG2, IgG3, IgG4, IgM, IgA and IgE).

Additional half-life extending moieties that may be conjugated to the antigen binding domains that bind CD3ε of the disclosure include polyethylene glycol (PEG) molecules, such as PEG5000 or PEG20,000, fatty acids and fatty acid esters of different chain lengths, for example laurate, myristate, stearate, arachidate, behenate, oleate, arachidonate, octanedioic acid, tetradecanedioic acid, octadecanedioic acid, docosanedioic acid, and the like, polylysine, octane, carbohydrates (dextran, cellulose, oligo- or polysaccharides) for desired properties. These moieties may be direct fusions with the antigen binding domains that bind CD3ε of the disclosure and may be generated by standard cloning and expression techniques. Alternatively, well known chemical coupling methods may be used to attach the moieties to recombinantly produced antigen binding domains that bind CD3ε of the disclosure.

A pegyl moiety may for example be conjugated to the antigen binding domain that bind CD3ε of the disclosure by incorporating a cysteine residue to the C-terminus of the antigen binding domain that bind CD3ε of the disclosure, or engineering cysteines into residue positions that face away from the CD3ε binding site and attaching a pegyl group to the cysteine using well known methods.

In other embodiments, the antigen binding fragment that binds CD3ε is conjugated to a half-life extending moiety.

In other embodiments, the half-life extending moiety is an immunoglobulin (Ig), a fragment of the Ig, an Ig constant region, a fragment of the Ig constant region, a Fc region, transferrin, albumin, an albumin binding domain or polyethylene glycol. In other embodiments, the half-life extending moiety is an Ig constant region.

In other embodiments, the half-life extending moiety is the Ig.

In other embodiments, the half-life extending moiety is the fragment of the Ig.

In other embodiments, the half-life extending moiety is the Ig constant region.

In other embodiments, the half-life extending moiety is the fragment of the Ig constant region.

In other embodiments, the half-life extending moiety is the Fc region.

In other embodiments, the half-life extending moiety is albumin.

In other embodiments, the half-life extending moiety is the albumin binding domain.

In other embodiments, the half-life extending moiety is transferrin.

In other embodiments, the half-life extending moiety is polyethylene glycol.

The antigen binding domains that bind CD3ε conjugated to a half-life extending moiety may be evaluated for their pharmacokinetic properties utilizing known in vivo models.

Conjugation to Immunoglobulin (Ig) Constant Regions or Fragments of the Ig Constant Regions The antigen binding domains that bind CD3ε of the disclosure may be conjugated to an Ig constant region or a fragment of the Ig constant region to impart antibody-like properties, including Fc effector functions C1q binding, complement dependent cytotoxicity (CDC), Fc receptor binding, antibody-dependent cell-mediated cytotoxicity (ADCC), phagocytosis or down regulation of cell surface receptors (e.g., B cell receptor; BCR). The Ig constant region or the fragment of the Ig constant region functions also as a half-life extending moiety as discussed herein. The antigen binding domains that bind CD3ε of the disclosure may be engineered into conventional full-length antibodies using standard methods. The full-length antibodies comprising the antigen binding domain that binds CD3ε may further be engineered as described herein.

Immunoglobulin heavy chain constant region comprised of subdomains CH1, hinge, CH2 and CH3. The CH1 domain spans residues A118-V215, the CH2 domain residues A231-K340 and the CH3 domain residues G341-K447 on the heavy chain, residue numbering according to the EU Index. In some instances, G341 is referred as a CH2 domain residue. Hinge is generally defined as including E216 and terminating at P230 of human IgG1. Ig Fc region comprises at least the CH2 and the CH3 domains of the Ig constant region, and therefore comprises at least a region from about A231 to K447 of Ig heavy chain constant region.

The invention also provides an antigen binding domain that binds CD3ε conjugated to an immunoglobulin (Ig) constant region or a fragment of the Ig constant region.

In other embodiments, the Ig constant region is a heavy chain constant region

In other embodiments, the Ig constant region is a light chain constant region.

In other embodiments, the fragment of the Ig constant region comprises a Fc region.

In other embodiments, the fragment of the Ig constant region comprises a CH2 domain.

In other embodiments, the fragment of the Ig constant region comprises a CH3 domain.

In other embodiments, the fragment of the Ig constant region comprises the CH2 domain and the CH3 domain.

In other embodiments, the fragment of the Ig constant region comprises at least portion of a hinge, the CH2 domain and the CH3 domain. Portion of the hinge refers to one or more amino acid residues of the Ig hinge.

In other embodiments, the fragment of the Ig constant region comprises the hinge, the CH2 domain and the CH3 domain.

In other embodiments, the antigen binding domain that binds CD3ε is conjugated to the N-terminus of the Ig constant region or the fragment of the Ig constant region.

In other embodiments, the antigen binding domain that binds CD3ε is conjugated to the C-terminus of the Ig constant region or the fragment of the Ig constant region.

In other embodiments, the antigen binding domain that binds CD3ε is conjugated to the Ig constant region or the fragment of the Ig constant region via a second linker (L2).

In other embodiments, the L2 comprises the amino acid sequence of SEQ ID NOs: 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, or 64.

In other embodiments, the L2 comprises the amino acid sequence of SEQ ID NO: 31.

In other embodiments, the L2 comprises the amino acid sequence of SEQ ID NO: 32.

In other embodiments, the L2 comprises the amino acid sequence of SEQ ID NO: 33.

In other embodiments, the L2 comprises the amino acid sequence of SEQ ID NO: 34.

In other embodiments, the L2 comprises the amino acid sequence of SEQ ID NO: 35.

In other embodiments, the L2 comprises the amino acid sequence of SEQ ID NO: 36.

In other embodiments, the L2 comprises the amino acid sequence of SEQ ID NO: 37.

In other embodiments, the L2 comprises the amino acid sequence of SEQ ID NO: 38.

In other embodiments, the L2 comprises the amino acid sequence of SEQ ID NO: 39.

In other embodiments, the L2 comprises the amino acid sequence of SEQ ID NO: 40.

In other embodiments, the L2 comprises the amino acid sequence of SEQ ID NO: 41.

In other embodiments, the L2 comprises the amino acid sequence of SEQ ID NO: 42.

In other embodiments, the L2 comprises the amino acid sequence of SEQ ID NO: 43.

In other embodiments, the L2 comprises the amino acid sequence of SEQ ID NO: 44.

In other embodiments, the L2 comprises the amino acid sequence of SEQ ID NO: 45.

In other embodiments, the L2 comprises the amino acid sequence of SEQ ID NO: 46.

In other embodiments, the L2 comprises the amino acid sequence of SEQ ID NO: 47.

In other embodiments, the L2 comprises the amino acid sequence of SEQ ID NO: 48.

In other embodiments, the L2 comprises the amino acid sequence of SEQ ID NO: 49.

In other embodiments, the L2 comprises the amino acid sequence of SEQ ID NO: 50.

In other embodiments, the L2 comprises the amino acid sequence of SEQ ID NO: 51.

In other embodiments, the L2 comprises the amino acid sequence of SEQ ID NO: 52.

In other embodiments, the L2 comprises the amino acid sequence of SEQ ID NO: 53.

In other embodiments, the L2 comprises the amino acid sequence of SEQ ID NO: 54.

In other embodiments, the L2 comprises the amino acid sequence of SEQ ID NO: 55.

In other embodiments, the L2 comprises the amino acid sequence of SEQ ID NO: 56.

In other embodiments, the L2 comprises the amino acid sequence of SEQ ID NO: 57.

In other embodiments, the L2 comprises the amino acid sequence of SEQ ID NO: 58.

In other embodiments, the L2 comprises the amino acid sequence of SEQ ID NO: 59.

In other embodiments, the L2 comprises the amino acid sequence of SEQ ID NO: 60.

In other embodiments, the L2 comprises the amino acid sequence of SEQ ID NO: 61.

In other embodiments, the L2 comprises the amino acid sequence of SEQ ID NO: 62.

In other embodiments, the L2 comprises the amino acid sequence of SEQ ID NO: 63.

In other embodiments, the L2 comprises the amino acid sequence of SEQ ID NO: 64.

The antigen binding domains that bind CD3ε of the disclosure conjugated to Ig constant region or the fragment of the Ig constant region may be assessed for their functionality using several known assays. Binding to CD3ε may be assessed using methods described herein. Altered properties imparted by the Ig constant domain or the fragment of the Ig constant region such as Fc region may be assayed in Fc receptor binding assays using soluble forms of the receptors, such as the FcγRI, FcγRII, FcγRIII or FcRn receptors, or using cell-based assays measuring for example ADCC, CDC or ADCP.

ADCC may be assessed using an in vitro assay using CD3ε expressing cells as target cells and NK cells as effector cells. Cytolysis may be detected by the release of label (e.g., radioactive substrates, fluorescent dyes or natural intracellular proteins) from the lysed cells. In an exemplary assay, target cells are used with a ratio of 1 target cell to 4 effector cells. Target cells are pre-labeled with BATDA and combined with effector cells and test antibody. The samples are incubated for 2 hours and cell lysis measured by measuring released BATDA into the supernatant. Data is normalized to maximal cytotoxicity with 0.67% Triton™ X-100 (polyethylene glycol p-(1,1,3,3-tetramethylbutyl)-phenyl ether; Sigma Aldrich) and minimal control determined by spontaneous release of BATDA from target cells in the absence of any antibody.

ADCP may be evaluated by using monocyte-derived macrophages as effector cells and any CD3ε expressing cells as target cells which are engineered to express GFP or other labeled molecule. In an exemplary assay, effector:target cell ratio may be for example 4:1. Effector cells may be incubated with target cells for 4 hours with or without the antibody of the invention. After incubation, cells may be detached using accutase. Macrophages may be identified with anti-CD11b and anti-CD14 antibodies coupled to a fluorescent label, and percent phagocytosis may be determined based on % GFP fluorescence in the $CD11^{+}CD14^{+}$ macrophages using standard methods.

CDC of cells may be measured for example by plating Daudi cells at $1\times10^{5}$ cells/well (50 μL/well) in RPMI-B (RPMI supplemented with 1% BSA), adding 50 μL of test protein to the wells at final concentration between 0-100 μg/mL, incubating the reaction for 15 min at room temperature, adding 11 μL of pooled human serum to the wells, and incubation the reaction for 45 min at 37° C. Percentage (%) lysed cells may be detected as % propidium iodide stained cells in FACS assay using standard methods.

Proteins Comprising the Antigen Binding Domains that Bind CD3ε of the Disclosure The antigen binding domains that bind CD3ε of the disclosure may be engineered into monospecific or multispecific proteins of various designs using standard methods.

The disclosure also provides a monospecific protein comprising the antigen binding domain that binds CD3ε of the disclosure.

In other embodiments, the monospecific protein is an antibody.

The disclosure also provides a multispecific protein comprising the antigen binding domain that binds CD3ε of the disclosure.

In other embodiments, the multispecific protein is bispecific.

In other embodiments, the multispecific protein is trispecific.

In other embodiments, the multispecific protein is tetraspecific.

In other embodiments, the multispecific protein is monovalent for binding to CD3ε.

In other embodiments, the multispecific protein is bivalent for binding to CD3ε.

The disclosure also provides an isolated multispecific protein comprising a first antigen binding domain that binds CD3ε and a second antigen binding domain that binds a tumor antigen.

In other embodiments, the tumor antigen is a hK2 antigen. In other embodiments, the tumor antigen is a HLA-G antigen. In other embodiments, the tumor antigen is a DLL3 antigen.

In other embodiments, the first antigen binding domain that binds CD3ε and/or the second antigen binding domain that binds the tumor antigen comprise a scFv, a $(scFv)_2$, a Fv, a Fab, a $F(ab')_2$, a Fd, a dAb or a VHH.

In other embodiments, the first antigen binding domain that binds CD3ε and/or the second antigen binding domain that binds the tumor antigen comprise the Fab.

In other embodiments, the first antigen binding domain that binds CD3ε and/or the second antigen binding domain that binds the tumor antigen comprise the $F(ab')_2$.

In other embodiments, the first antigen binding domain that binds CD3ε and/or the second antigen binding domain that binds the tumor antigen comprise the VHH.

In other embodiments, the first antigen binding domain that binds CD3ε and/or the second antigen binding domain that binds the tumor antigen comprise the Fv.

In other embodiments, the first antigen binding domain that binds CD3ε and/or the second antigen binding domain that binds the tumor antigen comprise the Fd.

In other embodiments, the first antigen binding domain that binds CD3ε and/or the second antigen binding domain that binds the tumor antigen comprise the scFv.

In other embodiments, the scFv comprises, from the N- to C-terminus, a VH, a first linker (L1) and a VL (VH-L1-VL) or the VL, the L1 and the VH (VL-L1-VH).

In other embodiments, the L1 comprises about 5-50 amino acids.

In other embodiments, the L1 comprises about 5-40 amino acids.

In other embodiments, the L1 comprises about 10-30 amino acids.

In other embodiments, the L1 comprises about 10-20 amino acids.

In other embodiments, the L1 comprises the amino acid sequence of SEQ ID NOs: 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, or 64.

In other embodiments, the L1 comprises the amino acid sequence of SEQ ID NO: 31.

In other embodiments, the L1 comprises the amino acid sequence of SEQ ID NO: 32.

In other embodiments, the L1 comprises the amino acid sequence of SEQ ID NO: 33.

In other embodiments, the L1 comprises the amino acid sequence of SEQ ID NO: 34.

In other embodiments, the L1 comprises the amino acid sequence of SEQ ID NO: 35.

In other embodiments, the L1 comprises the amino acid sequence of SEQ ID NO: 36.

In other embodiments, the L1 comprises the amino acid sequence of SEQ ID NO: 37.

In other embodiments, the L1 comprises the amino acid sequence of SEQ ID NO: 38.

In other embodiments, the L1 comprises the amino acid sequence of SEQ ID NO: 39.

In other embodiments, the L1 comprises the amino acid sequence of SEQ ID NO: 40.

In other embodiments, the L1 comprises the amino acid sequence of SEQ ID NO: 41.

In other embodiments, the L1 comprises the amino acid sequence of SEQ ID NO: 42.

In other embodiments, the L1 comprises the amino acid sequence of SEQ ID NO: 43.

In other embodiments, the L1 comprises the amino acid sequence of SEQ ID NO: 44.

In other embodiments, the L1 comprises the amino acid sequence of SEQ ID NO: 45.

In other embodiments, the L1 comprises the amino acid sequence of SEQ ID NO: 46.

In other embodiments, the L1 comprises the amino acid sequence of SEQ ID NO: 47.

In other embodiments, the L1 comprises the amino acid sequence of SEQ ID NO: 48.

In other embodiments, the L1 comprises the amino acid sequence of SEQ ID NO: 49.

In other embodiments, the L1 comprises the amino acid sequence of SEQ ID NO: 50.

In other embodiments, the L1 comprises the amino acid sequence of SEQ ID NO: 51.

In other embodiments, the L1 comprises the amino acid sequence of SEQ ID NO: 52.

In other embodiments, the L1 comprises the amino acid sequence of SEQ ID NO: 53.

In other embodiments, the L1 comprises the amino acid sequence of SEQ ID NO: 54.

In other embodiments, the L1 comprises the amino acid sequence of SEQ ID NO: 55.

In other embodiments, the L1 comprises the amino acid sequence of SEQ ID NO: 56.

In other embodiments, the L1 comprises the amino acid sequence of SEQ ID NO: 57.

In other embodiments, the L1 comprises the amino acid sequence of SEQ ID NO: 58.

In other embodiments, the L1 comprises the amino acid sequence of SEQ ID NO: 59.

In other embodiments, the L1 comprises the amino acid sequence of SEQ ID NO: 60.

In other embodiments, the L1 comprises the amino acid sequence of SEQ ID NO: 61.

In other embodiments, the L1 comprises the amino acid sequence of SEQ ID NO: 62.

In other embodiments, the L1 comprises the amino acid sequence of SEQ ID NO: 63.

In other embodiments, the L1 comprises the amino acid sequence of SEQ ID NO: 64.

In other embodiments, the first antigen binding domain that binds CD3ε comprises the HCDR1 of SEQ ID NOs: 6, 12, or 18, the HCDR2 of SEQ ID NOs: 7, 13, or 19, the HCDR3 of SEQ ID NOs: 8, 14, or 20, the LCDR1 of SEQ ID NOs: 9, 15, or 21, the LCDR2 of SEQ ID NOs: 10 or 16, and the LCDR3 of SEQ ID NOs: 11, 17, or 22.

In other embodiments, the first antigen binding domain that binds CD3ε comprises the HCDR1, the HCDR2, the HCDR3, the LCDR1, the LCDR2 and the LCDR3 of SEQ ID NOs: 6, 7, 8, 9, 10, and 11, respectively;

SEQ ID NOs: 12, 13, 14, 15, 16, and 17, respectively; or

SEQ ID NOs: 18, 19, 20, 21, 16, and 22, respectively.

In other embodiments, the first antigen binding domain that binds CD3ε comprises the VH of SEQ ID NO: 23 and the VL of SEQ ID NO: 24.

In other embodiments, the first antigen binding domain that binds CD3ε comprises the VH of SEQ ID NO: 23 and the VL of SEQ ID NO: 27.

In other embodiments, the first antigen binding domain that binds CD3ε comprises the VH of SEQ ID NO: 23 and the VL of SEQ ID NO: 28.

In other embodiments, the first antigen binding domain that binds CD3ε comprises the VH of SEQ ID NO: 23 and the VL of SEQ ID NO: 29.

In other embodiments, the first antigen binding domain that binds CD3ε comprises the VH of SEQ ID NO: 23 and the VL of SEQ ID NO: 30.

In other embodiments, the first antigen binding domain that binds CD3ε comprises the VH of SEQ ID NOs: 23 and the VL of SEQ ID NOs: 24, 27, 28, 29 or 30.

In other embodiments, the first antigen binding domain that binds CD3ε comprises the amino acid sequence of SEQ ID Nos: 65, 66, 67, 68, 69, 60, 71, 72, 73, or 74.

In other embodiments, the first antigen binding domain that binds CD3ε comprises the amino acid sequence of SEQ ID NO: 65.

In other embodiments, the first antigen binding domain that binds CD3ε comprises the amino acid sequence of SEQ ID NO: 66.

In other embodiments, the first antigen binding domain that binds CD3ε comprises the amino acid sequence of SEQ ID NO: 67.

In other embodiments, the first antigen binding domain that binds CD3ε comprises the amino acid sequence of SEQ ID NO: 68.

In other embodiments, the first antigen binding domain that binds CD3ε comprises the amino acid sequence of SEQ ID NO: 69.

In other embodiments, the first antigen binding domain that binds CD3ε comprises the amino acid sequence of SEQ ID NO: 70.

In other embodiments, the first antigen binding domain that binds CD3ε comprises the amino acid sequence of SEQ ID NO: 71.

In other embodiments, the first antigen binding domain that binds CD3ε comprises the amino acid sequence of SEQ ID NO: 72.

In other embodiments, the first antigen binding domain that binds CD3ε comprises the amino acid sequence of SEQ ID NO: 73.

In other embodiments, the first antigen binding domain that binds CD3ε comprises the amino acid sequence of SEQ ID NO: 74.

In other embodiments, the second antigen binding domain that binds a tumor antigen comprises the HCDR1 of SEQ ID NO: 149, the HCDR2 of SEQ ID NO: 150, the HCDR3 of SEQ ID NO: 151, the LCDR1 of SEQ ID NO: 171, the LCDR2 of SEQ ID NO: 172 and the LCDR3 of SEQ ID NO: 173; or the VH of SEQ ID NO: 126 and the VL of SEQ ID NO: 127.

In other embodiments, the second antigen binding domain that binds a tumor antigen comprises the HCDR1 of SEQ ID NO: 149, the HCDR2 of SEQ ID NO: 152, the HCDR3 of SEQ ID NO: 151, the LCDR1 of SEQ ID NO: 174, the LCDR2 of SEQ ID NO: 175 and the LCDR3 of SEQ ID NO: 173; or the VH of SEQ ID NO: 124 and the VL of SEQ ID NO: 125.

In other embodiments, the second antigen binding domain that binds a tumor antigen comprises the HCDR1 of SEQ ID NO: 149, the HCDR2 of SEQ ID NO: 152, the HCDR3 of SEQ ID NO: 151, the LCDR1 of SEQ ID NO: 174, the LCDR2 of SEQ ID NO: 175 and the LCDR3 of SEQ ID NO: 173; or the VH of SEQ ID NO: 128 and the VL of SEQ ID NO: 129.

In other embodiments, the second antigen binding domain that binds a tumor antigen comprises the HCDR1 of SEQ ID NO: 149, the HCDR2 of SEQ ID NO: 152, the HCDR3 of SEQ ID NO: 151, the LCDR1 of SEQ ID NO: 174, the LCDR2 of SEQ ID NO: 175 and the LCDR3 of SEQ ID NO: 173; or the VH of SEQ ID NO: 130 and the VL of SEQ ID NO: 131.

In other embodiments, the second antigen binding domain that binds a tumor antigen comprises the HCDR1 of SEQ ID NO: 149, the HCDR2 of SEQ ID NO: 152, the HCDR3 of SEQ ID NO: 151, the LCDR1 of SEQ ID NO: 171, the LCDR2 of SEQ ID NO: 172 and the LCDR3 of SEQ ID NO: 173; or the VH of SEQ ID NO: 132 and the VL of SEQ ID NO: 133.

In other embodiments, the second antigen binding domain that binds a tumor antigen comprises the HCDR1 of SEQ ID NO: 149, the HCDR2 of SEQ ID NO: 152, the HCDR3 of SEQ ID NO: 151, the LCDR1 of SEQ ID NO: 171, the LCDR2 of SEQ ID NO: 172 and the LCDR3 of SEQ ID NO: 173; or the VH of SEQ ID NO: 134 and the VL of SEQ ID NO: 135.

In other embodiments, the second antigen binding domain that binds a tumor antigen comprises the HCDR1 of SEQ ID NO: 149, the HCDR2 of SEQ ID NO: 152, the HCDR3 of SEQ ID NO: 151, the LCDR1 of SEQ ID NO: 171, the LCDR2 of SEQ ID NO: 172 and the LCDR3 of SEQ ID NO: 173; or the VH of SEQ ID NO: 136 and the VL of SEQ ID NO: 135.

In other embodiments, the second antigen binding domain that binds a tumor antigen comprises the HCDR1 of SEQ ID NO: 149, the HCDR2 of SEQ ID NO: 152, the HCDR3 of SEQ ID NO: 151, the LCDR1 of SEQ ID NO: 171, the LCDR2 of SEQ ID NO: 172 and the LCDR3 of SEQ ID NO: 173; or the VH of SEQ ID NO: 132 and the VL of SEQ ID NO: 135.

In other embodiments, the second antigen binding domain that binds a tumor antigen comprises the HCDR1 of SEQ ID NO: 153, the HCDR2 of SEQ ID NO: 154, the HCDR3 of SEQ ID NO: 155, the LCDR1 of SEQ ID NO: 176, the LCDR2 of SEQ ID NO: 177 and the LCDR3 of SEQ ID NO: 178; or the VH of SEQ ID NO: 137 and the VL of SEQ ID NO: 138.

In other embodiments, the second antigen binding domain that binds a tumor antigen comprises the HCDR1 of SEQ ID NO: 156, the HCDR2 of SEQ ID NO: 157, the HCDR3 of SEQ ID NO: 158, the LCDR1 of SEQ ID NO: 182, the LCDR2 of SEQ ID NO: 183 and the LCDR3 of SEQ ID NO: 184; or the VH of SEQ ID NO: 139 and the VL of SEQ ID NO: 140.

In other embodiments, the second antigen binding domain that binds a tumor antigen comprises the HCDR1 of SEQ ID NO: 159, the HCDR2 of SEQ ID NO: 160, the HCDR3 of SEQ ID NO: 161, the LCDR1 of SEQ ID NO: 179, the LCDR2 of SEQ ID NO: 180 and the LCDR3 of SEQ ID NO: 181; or the VH of SEQ ID NO: 141 and the VL of SEQ ID NO: 142.

In other embodiments, the second antigen binding domain that binds a tumor antigen comprises the HCDR1 of SEQ ID NO: 162, the HCDR2 of SEQ ID NO: 163, the HCDR3 of SEQ ID NO: 164, the LCDR1 of SEQ ID NO: 185, the LCDR2 of SEQ ID NO: 186 and the LCDR3 of SEQ ID NO: 187; or the VH of SEQ ID NO: 143 and the VL of SEQ ID NO: 144.

In other embodiments, the second antigen binding domain that binds a tumor antigen comprises the HCDR1 of SEQ ID NO: 165, the HCDR2 of SEQ ID NO: 166, the HCDR3 of SEQ ID NO: 167, the LCDR1 of SEQ ID NO: 191, the LCDR2 of SEQ ID NO: 192 and the LCDR3 of SEQ ID NO: 193; or the VH of SEQ ID NO: 145 and the VL of SEQ ID NO: 146.

In other embodiments, the second antigen binding domain that binds a tumor antigen comprises the HCDR1 of SEQ ID NO: 168, the HCDR2 of SEQ ID NO: 169, the HCDR3 of SEQ ID NO: 170, the LCDR1 of SEQ ID NO: 191, the LCDR2 of SEQ ID NO: 192 and the LCDR3 of SEQ ID NO: 188; or the VH of SEQ ID NO: 147 and the VL of SEQ ID NO: 148.

In other embodiments, the second antigen binding domain that binds a tumor antigen comprises the VH of SEQ ID NO: 143 and the VL of SEQ ID NO: 358.

In other embodiments, the first antigen binding domain that binds CD3ε is conjugated to a first immunoglobulin (Ig) constant region or a fragment of the first Ig constant region and/or the second antigen binding domain that binds the tumor antigen is conjugated to a second immunoglobulin (Ig) constant region or a fragment of the second Ig constant region.

In other embodiments, the fragment of the first Ig constant region and/or the fragment of the second Ig constant region comprises a Fc region.

In other embodiments, the fragment of the first Ig constant region and/or the fragment of the second Ig constant region comprises a CH2 domain.

In other embodiments, the fragment of the first Ig constant region and/or the fragment of the second Ig constant region comprises a CH3 domain.

In other embodiments, the fragment of the first Ig constant region and/or the fragment of the second Ig constant region comprises the CH2 domain and the CH3 domain.

In other embodiments, the fragment of the first Ig constant region and/or the fragment of the second Ig constant region comprises at least portion of a hinge, the CH2 domain and the CH3 domain.

In other embodiments, the fragment of the Ig constant region comprises the hinge, the CH2 domain and the CH3 domain.

In other embodiments, the multispecific protein further comprises a second linker (L2) between the first antigen binding domain that binds CD3ε and the first Ig constant region or the fragment of the first Ig constant region and the second antigen binding domain that binds the tumor antigen and the second Ig constant region or the fragment of the second Ig constant region.

In other embodiments, the L2 comprises the amino acid sequence of SEQ ID NOs: 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, or 64.

In other embodiments, the first Ig constant region or the fragment of the first Ig constant region and the second Ig constant region or the fragment of the second Ig constant region is an IgG1, an IgG2, and IgG3 or an IgG4 isotype.

In other embodiments, the first Ig constant region or the fragment of the first Ig constant region and the second Ig constant region or the fragment of the second Ig constant region is an IgG1 isotype.

In other embodiments, the first Ig constant region or the fragment of the first Ig constant region and the second Ig constant region or the fragment of the second Ig constant region is an IgG2 isotype.

In other embodiments, the first Ig constant region or the fragment of the first Ig constant region and the second Ig constant region or the fragment of the second Ig constant region is an IgG3 isotype.

In other embodiments, the first Ig constant region or the fragment of the first Ig constant region and the second Ig constant region or the fragment of the second Ig constant region is an IgG4 isotype.

The first Ig constant region or the fragment of the first Ig constant region and the second Ig constant region or the fragment of the second Ig constant region can further be engineered as described herein.

In other embodiments, the first Ig constant region or the fragment of the first Ig constant region and the second Ig constant region or the fragment of the second Ig constant region comprises at least one mutation that results in reduced binding of the multispecific protein to a FcγR.

In other embodiments, the at least one mutation that results in reduced binding of the multispecific protein to the FcγR is selected from the group consisting of F234A/L235A, L234A/L235A, L234A/L235A/D265S, V234A/G237A/P238S/H268A/V309L/A330S/P331S, F234A/L235A, S228P/F234A/L235A, N297A, V234A/G237A, K214T/E233P/L234V/L235A/G236-deleted/A327G/P331A/D365E/L358M, H268Q/V309L/A330S/P331S, S267E/L328F, L234F/L235E/D265A, L234A/L235A/G237A/P238S/H268A/A330S/P331S, S228P/F234A/L235A/G237A/P238S and S228P/F234A/L235A/G236-deleted/G237A/P238S, wherein residue numbering is according to the EU index.

In other embodiments, the first Ig constant region or the fragment of the first Ig constant region and the second Ig constant region or the fragment of the second Ig constant region comprises at least one mutation that results in enhanced binding of the multispecific protein to a Fcγ receptor (FcγR).

In other embodiments, the at least one mutation that results in enhanced binding of the multispecific protein to the FcγR is selected from the group consisting of S239D/I332E, S298A/E333A/K334A, F243L/R292P/Y300L, F243L/R292P/Y300L/P396L, F243L/R292P/Y300L/V305I/P396L and G236A/S239D/I332E, wherein residue numbering is according to the EU index.

In other embodiments, the FcγR is FcγRI, FcγRIIA, FcγRIIB or FcγRIII, or any combination thereof.

In other embodiments, the first Ig constant region or the fragment of the first Ig constant region and the second Ig constant region or the fragment of the second Ig constant region comprises at least one mutation that modulates a half-life of the multispecific protein.

In other embodiments, the at least one mutation that modulates the half-life of the multispecific protein is selected from the group consisting of H435A, P257I/N434H, D376V/N434H, M252Y/S254T/T256E/H433K/N434F, T308P/N434A and H435R, wherein residue numbering is according to the EU index.

In other embodiments, the multispecific protein comprises at least one mutation in a CH3 domain of the first Ig constant region or in a CH3 domain of the fragment of the first Ig constant region and/or at least one mutation in a CH3 domain of the second Ig constant region or in a CH3 domain of the fragment of the second Ig constant region.

In other embodiments, the at least one mutation in a CH3 domain of the first Ig constant region or in a CH3 domain of the fragment of the first Ig constant region and/or at least one mutation in a CH3 domain of the second Ig constant region or in a CH3 domain of the fragment of the second Ig constant region is selected from the group consisting of T350V, L351Y, F405A, Y407V, T366Y, T366W, T366L, F405W, K392L, T394W, T394S, Y407T, Y407A, T366S/L368A/Y407V, L351Y/F405A/Y407V, T366I/K392M/T394W, T366L/K392L/T394W, F405A/Y407V, T366L/K392M/T394W, L351Y/Y407A, L351Y/Y407V, T366A/K409F, L351Y/Y407A, T366V/K409F, T366A/K409F, T350V/L351Y/F405A/Y407V and T350V/T366L/K392L/T394W, wherein residue numbering is according to the EU index.

In other embodiments, the first Ig constant region or the fragment of the first Ig constant region and the second Ig constant region or the fragment of the second Ig constant region comprise the following mutations L235A_L235A_D265S_T350V_L351Y_F405A_Y407V in the first Ig constant region and L235A_L235A_D265S_T350V_T366L_K392L_T394W in the second Ig constant region; or L235A_L235A_D265S_T350V_T366L_K392L_T394W in the first Ig constant region and L235A_L235A_D265S_T350V_L351Y_F405A_Y407V in the second Ig constant region.

Generation of Multispecific Proteins that Comprise Antigen Binding Fragments that Bind CD3ε.

The antigen binding fragments that bind CD3ε of the disclosure may be engineered into multispecific antibodies which are also encompassed within the scope of the invention.

The antigen binding fragments that bind CD3ε may be engineered into full length multispecific antibodies which are generated using Fab arm exchange, in which substitutions are introduced into two monospecific bivalent antibodies within the Ig constant region CH3 domain which promote Fab arm exchange in vitro. In the methods, two monospecific bivalent antibodies are engineered to have certain substitutions at the CH3 domain that promote heterodimer stability; the antibodies are incubated together under reducing conditions sufficient to allow the cysteines in the hinge region to undergo disulfide bond isomerization; thereby generating the bispecific antibody by Fab arm exchange. The incubation conditions may optimally be restored to non-reducing. Exemplary reducing agents that may be used are 2-mercaptoethylamine (2-MEA), dithiothreitol (DTT), dithioerythritol (DTE), glutathione, tris(2-carboxyethyl)phosphine (TCEP), L-cysteine and beta-mercaptoethanol, preferably a reducing agent selected from the group consisting of: 2-mercaptoethylamine, dithiothreitol and tris(2-carboxyethyl)phosphine. For example, incubation for at least 90 min at a temperature of at least 20° C. in the presence of at least 25 mM 2-MEA or in the presence of at least 0.5 mM dithiothreitol at a pH of from 5-8, for example at pH of 7.0 or at pH of 7.4 may be used.

CH3 mutations that may be used include technologies such as Knob-in-Hole mutations (Genentech), electrostatically-matched mutations (Chugai, Amgen, NovoNordisk, Oncomed), the Strand Exchange Engineered Domain body (SEEDbody) (EMD Serono), Duobody® mutations (Genmab), and other asymmetric mutations (e.g. Zymeworks).

Knob-in-hole mutations are disclosed for example in WO1996/027011 and include mutations on the interface of CH3 region in which an amino acid with a small side chain (hole) is introduced into the first CH3 region and an amino acid with a large side chain (knob) is introduced into the second CH3 region, resulting in preferential interaction between the first CH3 region and the second CH3 region. Exemplary CH3 region mutations forming a knob and a hole are T366Y/F405A, T366W/F405W, F405W/Y407A, T394W/Y407T, T394S/Y407A, T366W/T394S, F405W/T394S and T366W/T366S_L368A_Y407V.

Heavy chain heterodimer formation may be promoted by using electrostatic interactions by substituting positively charged residues on the first CH3 region and negatively charged residues on the second CH3 region as described in US2010/0015133, US2009/0182127, US2010/028637 or US2011/0123532.

Other asymmetric mutations that can be used to promote heavy chain heterodimerization are L351Y_F405A_Y407V/T394W, T366I_K392M_T394W/F405A_Y407V, T366L_K392M_T394W/F405A_Y407V, L351Y_Y407A/T366A_K409F, L351Y_Y407A/T366V_K409F, Y407A/T366A_K409F, or T350V_L351Y_F405A_Y407V/T350V_T366L_K392L_T394W as described in US2012/0149876 or US2013/0195849 (Zymeworks).

SEEDbody mutations involve substituting select IgG residues with IgA residues to promote heavy chain heterodimerization as described in US20070287170.

Other exemplary mutations that may be used are R409D_K370E/D399K_E357K, S354C_T366W/Y349C_T366S_L368A_Y407V, Y349C_T366W/S354C_T366S_L368A_Y407V, T366K/L351D, L351K/Y349E, L351K/Y349D, L351K/L368E, L351Y_Y407A/T366A_K409F, L351Y_Y407A/T366V_K409F, K392D/D399K, K392D/E356K, K253E_D282K_K322D/D239K_E240K_K292D, K392D_K409D/D356K D399K as described in WO2007/147901, WO 2011/143545, WO2013157954, WO2013096291 and US2018/0118849.

Duobody® mutations (Genmab) are disclosed for example in U.S. Pat. No. 9,150,663 and US2014/0303356 and include mutations F405L/K409R, wild-type/F405L_R409K, T350I_K370T_F405L/K409R, K370W/K409R, D399AFGHILMNRSTVWY/K409R, T366ADEFGHILMQVY/K409R, L368ADEGHNRSTVQ/K409AGRH, D399FHKRQ/K409AGRH, F405IKLSTVW/K409AGRH and Y407LWQ/K409AGRH.

Additional bispecific or multispecific structures into which the antigen binding domains that bind CD3ε can be incorporated include Dual Variable Domain Immunoglobulins (DVD) (Int. Pat. Publ. No. WO2009/134776; DVDs are full length antibodies comprising the heavy chain having a structure VH1-linker-VH2-CH and the light chain having the structure VL1-linker-VL2-CL; linker being optional), structures that include various dimerization domains to connect the two antibody arms with different specificity, such as leucine zipper or collagen dimerization domains (Int. Pat. Publ. No. WO2012/022811, U.S. Pat. Nos. 5,932,448; 6,833,441), two or more domain antibodies (dAbs) conjugated together, diabodies, heavy chain only antibodies such as camelid antibodies and engineered camelid antibodies, Dual Targeting (DT)-Ig (GSK/Domantis), Two-in-one Antibody (Genentech), Cross-linked Mabs (Karmanos Cancer Center), mAb2 (F-Star) and CovX-body (CovX/Pfizer), IgG-like Bispecific (InnClone/Eli Lilly), Ts2Ab (MedImmune/AZ) and BsAb (Zymogenetics), HERCULES (Biogen Idec) and TvAb (Roche), ScFv/Fc Fusions (Academic Institution), SCORPION (Emergent BioSolutions/Trubion, Zymogenetics/BMS), Dual Affinity Retargeting Technology (Fc-DART) (MacroGenics) and Dual(ScFv)2-Fab (National Research Center for Antibody Medicine—China), Dual-Action or Bis-Fab (Genentech), Dock-and-Lock (DNL) (ImmunoMedics), Bivalent Bispecific (Biotecnol) and Fab-Fv (UCB-Celltech). ScFv-, diabody-based, and domain antibodies, include but are not limited to, Bispecific T Cell Engager (BiTE) (Micromet), Tandem Diabody (Tandab) (Affimed), Dual Affinity Retargeting Technology (DART)

(MacroGenics), Single-chain Diabody (Academic), TCR-like Antibodies (AIT, ReceptorLogics), Human Serum Albumin ScFv Fusion (Merrimack) and COMBODY (Epigen Biotech), dual targeting nanobodies (Ablynx), dual targeting heavy chain only domain antibodies.

The antigen binding domains that bind CD3ε of the disclosure may also be engineered into multispecific proteins which comprise three polypeptide chains. In such designs, at least one antigen binding domain is in the form of a scFv. Exemplary designs include (in which "1" indicates the first antigen binding domain, "2" indicates the second antigen binding domain and "3" indicates the third antigen binding domain:

Design 1: Chain A) scFv1-CH2-CH3; Chain B) VL2-CL; Chain C) VH2-CH1-hinge-CH2-CH3

Design 2: Chain A) scFv1-hinge-CH2-CH3; Chain B) VL2-CL; Chain C) VH2-CH1-hinge-CH2-CH3

Design 3: Chain A) scFv1-CH1-hinge-CH2-CH3; Chain B) VL2-CL; Chain C) VH2-CH1-hinge-CH2-CH3

Design 4: Chain A) CH2-CH3-scFv1; Chain B) VL2-CL; Chain C) VH2-CH1-hinge-CH2-CH3

CH3 engineering may be incorporated to the Designs 1-4, such as mutations L351Y_F405A_Y407V/T394W, T366I_K392M_T394W/F405A_Y407V, T366L_K392M_T394W/F405A_Y407V, L351Y_Y407A/T366A_K409F, L351Y_Y407A/T366V_K409F, Y407A/T366A_K409F, or T350V_L351Y_F405A_Y407V/T350V_T366L_K392L_T394W as described in US2012/0149876 or US2013/0195849 (Zymeworks).

Isotypes, Allotypes and Fc Engineering

The Ig constant region or the fragment of the Ig constant region, such as the Fc region present in the proteins of the disclosure may be of any allotype or isotype.

In other embodiments, the Ig constant region or the fragment of the Ig constant region is an IgG1 isotype.

In other embodiments, the Ig constant region or the fragment of the Ig constant region is an IgG2 isotype.

In other embodiments, the Ig constant region or the fragment of the Ig constant region is an IgG3 isotype.

In other embodiments, the Ig constant region or the fragment of the Ig constant region is an IgG4 isotype.

The Ig constant region or the fragment of the Ig constant region may be of any allotype. It is expected that allotype has no influence on properties of the Ig constant region, such as binding or Fc-mediated effector functions. Immunogenicity of therapeutic proteins comprising Ig constant regions of fragments thereof is associated with increased risk of infusion reactions and decreased duration of therapeutic response (Baert et al., (2003) *N Engl J Med* 348:602-08). The extent to which therapeutic proteins comprising Ig constant regions of fragments thereof induce an immune response in the host may be determined in part by the allotype of the Ig constant region (Stickler et al., (2011) *Genes and Immunity* 12:213-21). Ig constant region allotype is related to amino acid sequence variations at specific locations in the constant region sequences of the antibody. Table 3 shows select IgG1, IgG2 and IgG4 allotypes.

TABLE 3

| | Amino acid residue at position of diversity (residue numbering: EU Index) | | | | | | | |
|---|---|---|---|---|---|---|---|---|
| | IgG2 | | IgG4 | | IgG1 | | | |
| Allotype | 189 | 282 | 309 | 422 | 214 | 356 | 358 | 431 |
| G2m(n) | T | M | | | | | | |
| G2m(n−) | P | V | | | | | | |
| G2m(n)/(n−) | T | V | | | | | | |
| nG4m(a) | | | L | R | | | | |
| G1m(17) | | | | | K | E | M | A |
| G1m(17, 1) | | | | | K | D | L | A |
| G1m(3) | | | | | R | E | M | A |

C-terminal lysine (CTL) may be removed from the Ig constant region by endogenous circulating carboxypeptidases in the blood stream (Cai et al., (2011) *Biotechnol Bioeng* 108:404-412). During manufacturing, CTL removal may be controlled to less than the maximum level by control of concentration of extracellular $Zn^{2+}$, EDTA or EDTA—$Fe^{3+}$ as described in U.S. Patent Publ. No. US20140273092. CTL content of proteins may be measured using known methods.

In other embodiments, the antigen binding fragment that binds CD3ε conjugated to the Ig constant region has a C-terminal lysine content from about 10% to about 90%. In other embodiments, the C-terminal lysine content is from about 20% to about 80%. In other embodiments, the C-terminal lysine content is from about 40% to about 70%. In other embodiments, the C-terminal lysine content is from about 55% to about 70%. In other embodiments, the C-terminal lysine content is about 60%.

Fc region mutations may be made to the antigen binding domains that bind CD3ε conjugated to the Ig constant region or to the fragment of the Ig constant region to modulate their effector functions such as ADCC, ADCP and/or ADCP and/or pharmacokinetic properties. This may be achieved by introducing mutation(s) into the Fc that modulate binding of the mutated Fc to activating FcγRs (FcγRI, FcγRIIa, FcγRIII), inhibitory FcγRIIb and/or to FcRn.

In other embodiments, the antigen binding domain that binds CD3ε conjugated to the Ig constant region or the fragment of the Ig constant region comprises at least one mutation in the Ig constant region or in the fragment of the Ig constant region.

In other embodiments, the at least one mutation is in the Fc region.

In other embodiments, the antigen binding domain that binds CD3ε conjugated to the Ig constant region or to the fragment of the Ig constant region comprises at least one, two, three, four, five, six, seven, eight, nine, ten, eleven, twelve, thirteen, fourteen or fifteen mutations in the Fc region.

In other embodiments, the antigen binding domain that binds CD3ε conjugated to the Ig constant region or to the fragment of the Ig constant region comprises at least one mutation in the Fc region that modulates binding of the antibody to FcRn.

Fc positions that may be mutated to modulate half-life (e.g. binding to FcRn) include positions 250, 252, 253, 254, 256, 257, 307, 376, 380, 428, 434 and 435. Exemplary mutations that may be made singularly or in combination are mutations T250Q, M252Y, I253A, S254T, T256E, P257I, T307A, D376V, E380A, M428L, H433K, N434S, N434A, N434H, N434F, H435A and H435R. Exemplary singular or combination mutations that may be made to increase the half-life are mutations M428L/N434S, M252Y/S254T/

T256E, T250Q/M428L, N434A and T307A/E380A/N434A. Exemplary singular or combination mutations that may be made to reduce the half-life are mutations H435A, P257I/N434H, D376V/N434H, M252Y/S254T/T256E/H433K/N434F, T308P/N434A and H435R.

In other embodiments, the antigen binding domain that binds CD3ε conjugated to the Ig constant region or to the fragment of the Ig constant region comprises M252Y/S254T/T256E mutation.

In other embodiments, the antigen binding domain that binds CD3ε conjugated to the Ig constant region or to the fragment of the Ig constant region comprises at least one mutation in the Fc region that reduces binding of the protein to an activating Fcγ receptor (FcγR) and/or reduces Fc effector functions such as C1q binding, complement dependent cytotoxicity (CDC), antibody-dependent cell-mediated cytotoxicity (ADCC) or phagocytosis (ADCP).

Fc positions that may be mutated to reduce binding of the protein to the activating FcγR and subsequently to reduce effector function include positions 214, 233, 234, 235, 236, 237, 238, 265, 267, 268, 270, 295, 297, 309, 327, 328, 329, 330, 331 and 365. Exemplary mutations that may be made singularly or in combination are mutations K214T, E233P, L234V, L234A, deletion of G236, V234A, F234A, L235A, G237A, P238A, P238S, D265A, S267E, H268A, H268Q, Q268A, N297A, A327Q, P329A, D270A, Q295A, V309L, A327S, L328F, A330S and P331S in IgG1, IgG2, IgG3 or IgG4. Exemplary combination mutations that result in proteins with reduced ADCC are mutations L234A/L235A on IgG1, L234A/L235A/D265S on IgG1, V234A/G237A/P238S/H268A/V309L/A330S/P331S on IgG2, F234A/L235A on IgG4, S228P/F234A/L235A on IgG4, N297A on all Ig isotypes, V234A/G237A on IgG2, K214T/E233P/L234V/L235A/G236-deleted/A327G/P331A/D365E/L358M on IgG1, H268Q/V309L/A330S/P331S on IgG2, S267E/L328F on IgG1, L234F/L235E/D265A on IgG1, L234A/L235A/G237A/P238S/H268A/A330S/P331S on IgG1, S228P/F234A/L235A/G237A/P238S on IgG4, and S228P/F234A/L235A/G236-deleted/G237A/P238S on IgG4. Hybrid IgG2/4 Fc domains may also be used, such as Fc with residues 117-260 from IgG2 and residues 261-447 from IgG4.

Exemplary mutation that result in proteins with reduced CDC is a K322A mutation.

Well-known S228P mutation may be made in IgG4 to enhance IgG4 stability.

In other embodiments, the antigen binding domain that binds CD3ε conjugated to the Ig constant region or to the fragment of the Ig constant region comprises at least one mutation selected from the group consisting of K214T, E233P, L234V, L234A, deletion of G236, V234A, F234A, L235A, G237A, P238A, P238S, D265A, S267E, H268A, H268Q, Q268A, N297A, A327Q, P329A, D270A, Q295A, V309L, A327S, L328F, K322, A330S and P331S.

In other embodiments, the antigen binding domain that binds CD3ε conjugated to the Ig constant region or to the fragment of the Ig constant region comprises L234A/L235A/D265S mutation.

In other embodiments, the antigen binding domain that binds CD3ε conjugated to the Ig constant region or to the fragment of the Ig constant region comprises L234A/L235A mutation.

In other embodiments, the antigen binding domain that binds CD3ε conjugated to the Ig constant region or to the fragment of the Ig constant region comprises at least one mutation in the Fc region that enhances binding of the protein to an Fcγ receptor (FcγR) and/or enhances Fc effector functions such as C1q binding, complement dependent cytotoxicity (CDC), antibody-dependent cell-mediated cytotoxicity (ADCC) and/or phagocytosis (ADCP).

Fc positions that may be mutated to increase binding of the protein to the activating FcγR and/or enhance Fc effector functions include positions 236, 239, 243, 256, 290, 292, 298, 300, 305, 312, 326, 330, 332, 333, 334, 345, 360, 339, 378, 396 or 430 (residue numbering according to the EU index). Exemplary mutations that may be made singularly or in combination are G236A, S239D, F243L, T256A, K290A, R292P, S298A, Y300L, V305L, K326A, A330K, 1332E, E333A, K334A, A339T and P396L. Exemplary combination mutations that result in proteins with increased ADCC or ADCP are a S239D/1332E, S298A/E333A/K334A, F243L/R292P/Y300L, F243L/R292P/Y300L/P396L, F243L/R292P/Y300L/V305I/P396L and G236A/S239D/I332E.

Fc positions that may be mutated to enhance CDC include positions 267, 268, 324, 326, 333, 345 and 430. Exemplary mutations that may be made singularly or in combination are S267E, F1268F, S324T, K326A, K326W, E333A, E345K, E345Q, E345R, E345Y, E430S, E430F and E430T. Exemplary combination mutations that result in proteins with increased CDC are K326A/E333A, K326W/E333A, H268F/S324T, S267E/H268F, S267E/S324T and S267E/H268F/S324T.

The specific mutations described herein are mutations when compared to the IgG1, IgG2 and IgG4 wild-type amino acid sequences of SEQ ID NOs: 95, 96, and 97, respectively.

```
wild-type IgG1
                                        SEQ ID NO: 95
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKKVEP

KSCDKTHTCPPCPAPELLGGPSVFLFPPKPKDTLMISRTPEVTCVVVDVS

HEDPEVKFNWYVDGVEVHNAKTKPREEQYNSTYRVVSVLTVLHQDWLNGK

EYKCKVSNKALPAPIEKTISKAKGQPREPQVYTLPPSRDELTKNQVSLTC

LVKGFYPSDIAVEWESNGQPENNYKTTPPVLDSDGSFFLYSKLTVDKSRW

QQGNVFSCSVMHEALHNHYTQKSLSLSPGK,

wild-type IgG2
                                        SEQ ID NO: 96
ASTKGPSVFPLAPCSRSTSESTAALGCLVKDYFPEPVTVSWNSGALTSGV

HTFPAVLQSSGLYSLSSVVTVPSSNFGTQTYTCNVDHKPSNTKVDKTVER

KCCVECPPCPAPPVAGPSVFLFPPKPKDTLMISRTPEVTCVVVDVSHEDP

EVQFNWYVDGVEVHNAKTKPREEQFNSTFRVVSVLTVVHQDWLNGKEYKC

KVSNKGLPAPIEKTISKTKGQPREPQVYTLPPSREEMTKNQVSLTCLVKG

FYPSDISVEWESNGQPENNYKTTPPMLDSDGSFFLYSKLTVDKSRWQQGN

VFSCSVMHEALHNHYTQKSLSLSPGK;

wild-type IgG4
                                        SEQ ID NO: 97
ASTKGPSVFPLAPCSRSTSESTAALGCLVKDYFPEPVTVSWNSGALTSGV

HTFPAVLQSSGLYSLSSVVTVPSSSLGTKTYTCNVDHKPSNTKVDKRVES

KYGPPCPSCPAPEFLGGPSVFLFPPKPKDTLMISRTPEVTCVVVDVSQED

PEVQFNWYVDGVEVHNAKTKPREEQFNSTYRVVSVLTVLHQDWLNGKEYK

CKVSNKGLPSSIEKTISKAKGQPREPQVYTLPPSQEEMTKNQVSLTCLVK
```

-continued

GFYPSDIAVEWESNGQPENNYKTTPPVLDSDGSFFLYSRLTVDKSRWQEG

NVFSCSVMHEALHNHYTQKSLSLSLGK;

Binding of the antibody to FcγR or FcRn may be assessed on cells engineered to express each receptor using flow cytometry. In an exemplary binding assay, $2\times10^5$ cells per well are seeded in 96-well plate and blocked in BSA Stain Buffer (BD Biosciences, San Jose, USA) for 30 min at 4° C. Cells are incubated with a test antibody on ice for 1.5 hour at 4° C. After being washed twice with BSA stain buffer, the cells are incubated with R-PE labeled anti-human IgG secondary antibody (Jackson Immunoresearch Laboratories) for 45 min at 4° C. The cells are washed twice in stain buffer and then resuspended in 150 μL of Stain Buffer containing 1:200 diluted DRAQ7 live/dead stain (Cell Signaling Technology, Danvers, USA). PE and DRAQ7 signals of the stained cells are detected by Miltenyi MACSQuant flow cytometer (Miltenyi Biotec, Auburn, USA) using B2 and B4 channel respectively. Live cells are gated on DRAQ7 exclusion and the geometric mean fluorescence signals are determined for at least 10,000 live events collected. FlowJo software (Tree Star) is used for analysis. Data is plotted as the logarithm of antibody concentration versus mean fluorescence signals. Nonlinear regression analysis is performed.

Glycoengineering

The ability of the antigen binding domain that binds CD3ε conjugated to the Ig constant region or to the fragment of the Ig constant region to mediate ADCC can be enhanced by engineering the Ig constant region or the fragment of the Ig constant region oligosaccharide component. Human IgG1 or IgG3 are N-glycosylated at Asn297 with the majority of the glycans in the well-known biantennary GO, G0F, G1, G1F, G2 or G2F forms. Ig constant region containing proteins may be produced by non-engineered CHO cells typically have a glycan fucose content of about at least 85%. The removal of the core fucose from the biantennary complex-type oligosaccharides attached to the antigen binding domain that binds CD3ε conjugated to the Ig constant region or to the fragment of the Ig constant region enhances the ADCC of the protein via improved FcγRIIIa binding without altering antigen binding or CDC activity. Such proteins can be achieved using different methods reported to lead to the successful expression of relatively high defucosylated immunoglobulins bearing the biantennary complex-type of Fc oligosaccharides such as control of culture osmolality (Konno et al., Cytotechnology 64(:249-65, 2012), application of a variant CHO line Lec13 as the host cell line (Shields et al., *J Biol Chem* 277:26733-26740, 2002), application of a variant CHO line EB66 as the host cell line (Olivier et al., *MAbs;* 2(4): 405-415, 2010; PMID: 20562582), application of a rat hybridoma cell line YB2/0 as the host cell line (Shinkawa et al., *J Biol Chem* 278:3466-3473, 2003), introduction of small interfering RNA specifically against the a 1,6-fucosyltrasferase (FUT8) gene (Mori et al., *Biotechnol Bioeng* 88:901-908, 2004), or coexpression of β-1,4-N-acetylglucosaminyltransferase III and Golgi α-mannosidase II or a potent alpha-mannosidase I inhibitor, kifunensine (Ferrara et al., *J Biol Chem* 281:5032-5036, 2006, Ferrara et al., *Biotechnol Bioeng* 93:851-861, 2006; Xhou et al., *Biotechnol Bioeng* 99:652-65, 2008).

In other embodiments, the antigen binding domain that binds CD3ε conjugated to the Ig constant region or to the fragment of the Ig constant region of the disclosure has a biantennary glycan structure with fucose content of about between 1% to about 15%, for example about 15%, 14%, 13%, 12%, 11% 10%, 9%, 8%, 7%, 6%, 5%, 4%, 3%, 2% or 1%. In other embodiments, the antigen binding domain that binds CD3ε conjugated to the Ig constant region or to the fragment of the Ig constant region has a glycan structure with fucose content of about 50%, 40%, 45%, 40%, 35%, 30%, 25%, or 20%. "Fucose content" means the amount of the fucose monosaccharide within the sugar chain at Asn297. The relative amount of fucose is the percentage of fucose-containing structures related to all glycostructures. These may be characterized and quantified by multiple methods, for example: 1) using MALDI-TOF of N-glycosidase F treated sample (e.g. complex, hybrid and oligo- and high-mannose structures) as described in Int Pat. Publ. No. WO2008/077546 2); 2) by enzymatic release of the Asn297 glycans with subsequent derivatization and detection/quantitation by HPLC (UPLC) with fluorescence detection and/or HPLC-MS (UPLC-MS); 3) intact protein analysis of the native or reduced mAb, with or without treatment of the Asn297 glycans with Endo S or other enzyme that cleaves between the first and the second GlcNAc monosaccharides, leaving the fucose attached to the first GlcNAc; 4) digestion of the mAb to constituent peptides by enzymatic digestion (e.g., trypsin or endopeptidase Lys-C), and subsequent separation, detection and quantitation by HPLC-MS (UPLC-MS); 5) Separation of the mAb oligosaccharides from the mAb protein by specific enzymatic deglycosylation with PNGase F at Asn 297. The oligosaccharides thus released can be labeled with a fluorophore, separated and identified by various complementary techniques which allow: fine characterization of the glycan structures by matrix-assisted laser desorption ionization (MALDI) mass spectrometry by comparison of the experimental masses with the theoretical masses, determination of the degree of sialylation by ion exchange HPLC (GlycoSep C), separation and quantification of the oligosaccharide forms according to hydrophilicity criteria by normal-phase HPLC (GlycoSep N), and separation and quantification of the oligosaccharides by high performance capillary electrophoresis-laser induced fluorescence (HPCE-LIF).

"Low fucose" or "low fucose content" as used herein refers to the antigen binding domain that bind CD3ε conjugated to the Ig constant region or to the fragment of the Ig constant region with fucose content of about between 1%-15%.

"Normal fucose" or "normal fucose content" as used herein refers to the antigen binding domain that bind CD3ε conjugated to the Ig constant region or to the fragment of the Ig constant region with fucose content of about over 50%, typically about over 80% or over 85%.

Anti-Idiotypic Antibodies

Anti-idiotypic antibodies are antibodies that specifically bind to the antigen binding domain that binds CD3ε of the disclosure.

The invention also provides an anti-idiotypic antibody that specifically binds to the antigen binding domain that binds CD3ε of the disclosure.

The invention also provides an anti-idiotypic antibody that specifically binds to the antigen binding domain that binds CD3ε comprising the VH of SEQ ID NO: 23 and the VL of SEQ ID NO: 24;
the VH of SEQ ID NO: 23 and the VL of SEQ ID NO: 27;
the VH of SEQ ID NO: 23 and the VL of SEQ ID NO: 28;
the VH of SEQ ID NO: 23 and the VL of SEQ ID NO: 29; or
the VH of SEQ ID NO: 23 and the VL of SEQ ID NO: 30.

An anti-idiotypic (Id) antibody is an antibody which recognizes the antigenic determinants (e.g. the paratope or CDRs) of the antibody. The Id antibody may be antigen-blocking or non-blocking. The antigen-blocking Id may be used to detect the free antigen binding domain in a sample (e.g. the antigen binding domain that binds CD3ε of the disclosure). The non-blocking Id may be used to detect the total antibody (free, partially bond to antigen, or fully bound to antigen) in a sample. An Id antibody may be prepared by immunizing an animal with the antibody to which an anti-Id is being prepared.

An anti-Id antibody may also be used as an immunogen to induce an immune response in yet another animal, producing a so-called anti-anti-Id antibody. An anti-anti-Id may be epitopically identical to the original antigen binding domain which induced the anti-Id. Thus, by using antibodies to the idiotypic determinants of the antigen binding domain, it is possible to identify other clones expressing antigen binding domains of identical specificity. Anti-Id antibodies may be varied (thereby producing anti-Id antibody variants) and/or derivatized by any suitable technique, such as those described elsewhere herein.

Immunoconjugates

The antigen binding domains that bind CD3ε of the disclosure, the proteins comprising the antigen binding domains that bind CD3ε or the multispecific proteins that comprise the antigen binding domains that bind CD3ε (collectively referred herein as to CD3ε binding proteins) may be conjugated to a heterologous molecule.

In other embodiments, the heterologous molecule is a detectable label or a cytotoxic agent.

The invention also provides an antigen binding domain that binds CD3ε conjugated to a detectable label.

The invention also provides a protein comprising an antigen binding domain that binds CD3ε conjugated to a detectable label.

The invention also provides a multispecific protein comprising an antigen binding domain that binds CD3ε conjugated to a detectable label.

The invention also provides an antigen binding domain that binds CD3ε conjugated to a cytotoxic agent.

The invention also provides a protein comprising an antigen binding domain that binds CD3ε conjugated to a cytotoxic agent.

The invention also provides a multispecific protein comprising an antigen binding domain that binds CD3ε conjugated to a cytotoxic agent.

CD3ε binding proteins of the disclosure may be used to direct therapeutics to tumor antigen expressing cells. Alternatively, CD3ε expressing cells may be targeted with a CD3ε binding protein of the disclosure coupled to a therapeutic intended to modify cell function once internalized.

In other embodiments, the detectable label is also a cytotoxic agent.

The CD3ε binding proteins of the disclosure conjugated to a detectable label may be used to evaluate expression of CD3ε on a variety of samples.

Detectable label includes compositions that when conjugated to the CD3ε binding proteins of the disclosure renders the latter detectable, via spectroscopic, photochemical, biochemical, immunochemical, or chemical means.

Exemplary detectable labels include radioactive isotopes, magnetic beads, metallic beads, colloidal particles, fluorescent dyes, electron-dense reagents, enzymes (for example, as commonly used in an ELISA), biotin, digoxigenin, haptens, luminescent molecules, chemiluminescent molecules, fluorochromes, fluorophores, fluorescent quenching agents, colored molecules, radioactive isotopes, scintillates, avidin, streptavidin, protein A, protein G, antibodies or fragments thereof, polyhistidine, $Ni^{2+}$, Flag tags, myc tags, heavy metals, enzymes, alkaline phosphatase, peroxidase, luciferase, electron donors/acceptors, acridinium esters, and colorimetric substrates.

A detectable label may emit a signal spontaneously, such as when the detectable label is a radioactive isotope. In other cases, the detectable label emits a signal as a result of being stimulated by an external field.

Exemplary radioactive isotopes may be γ-emitting, Auger-emitting, β-emitting, an alpha-emitting or positron-emitting radioactive isotope. Exemplary radioactive isotopes include $^{3}H$, $^{11}C$, $^{13}C$, $^{15}N$, $^{18}F$, $^{19}F$, $^{55}Co$, $^{57}Co$, $^{60}Co$, $^{61}Cu$, $^{62}Cu$, $^{64}Cu$, $^{67}Cu$, $^{68}Ga$, $^{72}As$, $^{75}Br$, $^{86}Y$, $^{89}Zr$, $^{90}Sr$, $^{94m}Tc$, $^{99m}Tc$, $^{115}In$, $^{123}I$, $^{124}I$, $^{125}I$, $^{131}I$, $^{211}At$, $^{212}Bi$, $^{213}Bi$, $^{223}Ra$, $^{226}Ra$, $^{225}Ac$ and $^{227}Ac$.

Exemplary metal atoms are metals with an atomic number greater than 20, such as calcium atoms, scandium atoms, titanium atoms, vanadium atoms, chromium atoms, manganese atoms, iron atoms, cobalt atoms, nickel atoms, copper atoms, zinc atoms, gallium atoms, germanium atoms, arsenic atoms, selenium atoms, bromine atoms, krypton atoms, rubidium atoms, strontium atoms, yttrium atoms, zirconium atoms, niobium atoms, molybdenum atoms, technetium atoms, ruthenium atoms, rhodium atoms, palladium atoms, silver atoms, cadmium atoms, indium atoms, tin atoms, antimony atoms, tellurium atoms, iodine atoms, xenon atoms, cesium atoms, barium atoms, lanthanum atoms, hafnium atoms, tantalum atoms, tungsten atoms, rhenium atoms, osmium atoms, iridium atoms, platinum atoms, gold atoms, mercury atoms, thallium atoms, lead atoms, bismuth atoms, francium atoms, radium atoms, actinium atoms, cerium atoms, praseodymium atoms, neodymium atoms, promethium atoms, samarium atoms, europium atoms, gadolinium atoms, terbium atoms, dysprosium atoms, holmium atoms, erbium atoms, thulium atoms, ytterbium atoms, lutetium atoms, thorium atoms, protactinium atoms, uranium atoms, neptunium atoms, plutonium atoms, americium atoms, curium atoms, berkelium atoms, californium atoms, einsteinium atoms, fermium atoms, mendelevium atoms, nobelium atoms, or lawrencium atoms.

In other embodiments, the metal atoms may be alkaline earth metals with an atomic number greater than twenty.

In other embodiments, the metal atoms may be lanthanides.

In other embodiments, the metal atoms may be actinides.

In other embodiments, the metal atoms may be transition metals.

In other embodiments, the metal atoms may be poor metals.

In other embodiments, the metal atoms may be gold atoms, bismuth atoms, tantalum atoms, and gadolinium atoms.

In other embodiments, the metal atoms may be metals with an atomic number of 53 (i.e. iodine) to 83 (i.e. bismuth).

In other embodiments, the metal atoms may be atoms suitable for magnetic resonance imaging.

The metal atoms may be metal ions in the form of +1, +2, or +3 oxidation states, such as $Ba^{2+}$, $Bi^{3+}$, $Cs^{+}$, $Ca^{2+}$, $Cr^{2+}$, $Cr^{3+}$, $Cr^{6+}$, $Co^{2+}$, $Co^{3+}$, $Cu^{+}$, $Cu^{2+}$, $Cu^{3+}$, $Ga^{3+}$, $Gd^{3+}$, $Au^{+}$, $Au^{3+}$, $Fe^{2+}$, $Fe^{3+}$, $F^{3+}$, $Pb^{2+}$, $Mn^{2+}$, $Mn^{+3}$, $Mn^{4+}$, $Mn^{7+}$, $Hg^{2+}$, $Ni^{2+}$, $Ni^{3+}$, $Ag^{+}$, $Sr^{2+}$, $Sn^{2+}$, $Sn^{4+}$, and $Zn^{2+}$. The metal atoms may comprise a metal oxide, such as iron oxide, manganese oxide, or gadolinium oxide.

Suitable dyes include any commercially available dyes such as, for example, 5(6)-carboxyfluorescein, IRDye® 680RD malimide or IRDye® 800CW, ruthenium polypyridyl dyes, and the like.

Suitable fluorophores are fluorescein isothiocyanate (FITC), fluorescein thiosemicarbazide, rhodamine, Texas Red, CyDyes (e.g., Cy3, Cy5, Cy5.5), Alexa Fluor®s (e.g., Alexa Fluor® 488, Alexa Fluor® 555, Alexa Fluor® 594, Alexa Fluor® 647), near infrared (NIR) (700-900 nm) fluorescent dyes, and carbocyanine and aminostyryl dyes.

The antigen binding domain that binds CD3ε conjugated to a detectable label may be used as an imaging agent.

The protein comprising an antigen binding domain that binds CD3ε conjugated to a detectable label may be used as an imaging agent.

The multispecific protein comprising an antigen binding domain that binds CD3ε conjugated to a detectable label may be used as an imaging agent.

In other embodiments, the cytotoxic agent is a chemotherapeutic agent, a drug, a growth inhibitory agent, a toxin (e.g., an enzymatically active toxin of bacterial, fungal, plant, or animal origin, or fragments thereof), or a radioactive isotope (i.e., a radioconjugate).

In other embodiments, the cytotoxic agent is daunomycin, doxorubicin, methotrexate, vindesine, bacterial toxins such as diphtheria toxin, ricin, geldanamycin, maytansinoids or calicheamicin. The cytotoxic agent may elicit their cytotoxic and cytostatic effects by mechanisms including tubulin binding, DNA binding, or topoisomerase inhibition.

In other embodiments, the cytotoxic agent is an enzymatically active toxin such as diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *Momordica charantia* inhibitor, curcin, crotin, *Sapaonaria officinalis* inhibitor, gelonin, mitogellin, restrictocin, phenomycin, enomycin, and the tricothecenes.

In other embodiments, the cytotoxic agent is a radionuclide, such as $^{212}$Bi, $^{131}$I, $^{131}$In, $^{90}$Y, and $^{186}$Re.

In other embodiments, the cytotoxic agent is dolastatins or dolostatin peptidic analogs and derivatives, auristatin or monomethyl auristatin phenylalanine. Exemplary molecules are disclosed in U.S. Pat. Nos. 5,635,483 and 5,780,588. Dolastatins and auristatins have been shown to interfere with microtubule dynamics, GTP hydrolysis, and nuclear and cellular division (Woyke et al (2001) Antimicrob Agents and Chemother. 45(12):3580-3584) and have anticancer and antifungal activity. The dolastatin or auristatin drug moiety may be attached to the antibody of the invention through the N (amino) terminus or the C (carboxyl) terminus of the peptidic drug moiety (WO02/088172), or via any cysteine engineered into the antibody.

The CD3ε binding proteins of the disclosure may be conjugated to a detectable label using known methods.

In other embodiments, the detectable label is complexed with a chelating agent.

In other embodiments, the detectable label is conjugated to the CD3ε binding proteins of the disclosure via a linker.

The detectable label or the cytotoxic moiety may be linked directly, or indirectly, to the CD3ε binding proteins of the disclosure using known methods. Suitable linkers are known in the art and include, for example, prosthetic groups, non-phenolic linkers (derivatives of N-succimidyl-benzoates; dodecaborate), chelating moieties of both macrocyclics and acyclic chelators, such as derivatives of 1,4,7,10-tetraazacyclododecane-1,4,7,10,tetraacetic acid (DOTA), derivatives of diethylenetriaminepentaacetic avid (DTPA), derivatives of S-2-(4-Isothiocyanatobenzyl)-1,4,7-triazacyclononane-1,4,7-triacetic acid (NOTA) and derivatives of 1,4,8,11-tetraazacyclodocedan-1,4,8,11-tetraacetic acid (TETA), N-succinimidyl-3-(2-pyridyldithiol) propionate (SPDP), iminothiolane (IT), bifunctional derivatives of imidoesters (such as dimethyl adipimidate HCl), active esters (such as disuccinimidyl suberate), aldehydes (such as glutaraldehyde), bis-azido compounds (such as bis(p-azidobenzoyl)hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene) and other chelating moieties. Suitable peptide linkers are well known.

In other embodiments, the CD3ε binding proteins of the disclosure is removed from the blood via renal clearance.

Kits

The invention also provides a kit comprising the antigen binding domain that binds CD3ε.

The invention also provides a kit comprising the protein comprising an antigen binding domain that binds CD3ε.

The invention also provides a kit comprising the multispecific protein comprising an antigen binding domain that binds CD3ε.

The kit may be used for therapeutic uses and as diagnostic kits.

The kit may be used to detect the presence of CD3ε in a sample.

In other embodiments, the kit comprises the CD3ε binding protein of the disclosure and reagents for detecting the CD3ε binding protein. The kit can include one or more other elements including: instructions for use; other reagents, e.g., a label, a therapeutic agent, or an agent useful for chelating, or otherwise coupling, an antibody to a label or therapeutic agent, or a radioprotective composition; devices or other materials for preparing the antibody for administration; pharmaceutically acceptable carriers; and devices or other materials for administration to a subject.

In other embodiments, the kit comprises the antigen binding domain that binds CD3ε in a container and instructions for use of the kit.

In other embodiments, the kit comprises the protein comprising an antigen binding domain that binds CD3ε in a container and instructions for use of the kit.

In other embodiments, the kit comprises the multispecific protein comprising an antigen binding domain that binds CD3ε in a container and instructions for use of the kit.

In other embodiments, the antigen binding domain that binds CD3ε in the kit is labeled.

In other embodiments, the protein comprising an antigen binding domain that binds CD3ε in the kit is labeled.

In other embodiments, the multispecific protein comprising an antigen binding domain that binds CD3ε in the kit is labeled.

In other embodiments, the kit comprises the antigen binding domain that binds CD3ε comprising the VH of SEQ ID NO: 23 and the VL of SEQ ID NO: 24;
the VH of SEQ ID NO: 23 and the VL of SEQ ID NO: 27;
the VH of SEQ ID NO: 23 and the VL of SEQ ID NO: 28;
the VH of SEQ ID NO: 23 and the VL of SEQ ID NO: 29; or
the VH of SEQ ID NO: 23 and the VL of SEQ ID NO: 30;

In other embodiments, the kit comprises the antigen binding domain that binds CD3ε comprising SEQ ID NOs: 65, 66, 67, 68, 69, 70, 71, 72, 73, or 74.

Methods of Detecting CD3ε

The invention also provides a method of detecting CD3ε in a sample, comprising obtaining the sample, contacting the sample with the antigen binding domain that binds CD3ε of the disclosure and detecting the bound CD3ε in the sample.

In other embodiments, the sample may be derived from urine, blood, serum, plasma, saliva, ascites, circulating cells, synovial fluid, circulating cells, cells that are not tissue associated (i.e., free cells), tissues (e.g., surgically resected tissue, biopsies, including fine needle aspiration), histological preparations, and the like.

The antigen binding domain that binds CD3ε of the disclosure may be detected using known methods. Exemplary methods include direct labeling of the antibodies using fluorescent or chemiluminescent labels, or radiolabels, or attaching to the antibodies of the invention a moiety which is readily detectable, such as biotin, enzymes or epitope tags. Exemplary labels and moieties are ruthenium, $^{111}$In-DOTA, $^{111}$In-diethylenetriaminepentaacetic acid (DTPA), horseradish peroxidase, alkaline phosphatase and beta-galactosidase, poly-histidine (HIS tag), acridine dyes, cyanine dyes, fluorone dyes, oxazin dyes, phenanthridine dyes, rhodamine dyes and Alexafluor® dyes.

The antigen binding domain that binds CD3ε of the disclosure may be used in a variety of assays to detect CD3ε in the sample. Exemplary assays are western blot analysis, radioimmunoassay, surface plasmon resonance, immunoprecipitation, equilibrium dialysis, immunodiffusion, electrochemiluminescence (ECL) immunoassay, immunohistochemistry, fluorescence-activated cell sorting (FACS) or ELISA assay.

Polynucleotides, Vectors, Host Cells

The disclosure also provides an isolated polynucleotide encoding any of the CD3ε binding proteins of the disclosure. The CD3ε binding protein includes the antigen binding domains that bind CD3ε, the proteins comprising the antigen binding domains that bind CD3ε, the multispecific proteins that comprise the antigen binding domains that bind CD3ε of the disclosure.

The invention also provides an isolated polynucleotide encoding any of CD3ε biding proteins or fragments thereof.

The invention also provides an isolated polynucleotide encoding the VH of SEQ ID NO: 23.

The invention also provides an isolated polynucleotide encoding the VL of SEQ ID NOs: 24, 27, 28, 29 or 30.

The invention also provides an isolated polynucleotide encoding the VL of SEQ ID NO: 24.

The invention also provides an isolated polynucleotide encoding the VL of SEQ ID NO: 27.

The invention also provides an isolated polynucleotide encoding the VL of SEQ ID NO: 28.

The invention also provides an isolated polynucleotide encoding the VL of SEQ ID NO: 29.

The invention also provides an isolated polynucleotide encoding the VL of SEQ ID NO: 30.

The invention also provides an isolated polynucleotide encoding the VH of SEQ ID NO: 23 and the VL of SEQ ID NOs: 24, 27, 28, 29 or 30.

The invention also provides for an isolated polynucleotide encoding the VH of SEQ ID NO: 23 and the VL of SEQ ID NO: 24;
the VH of SEQ ID NO: 23 and the VL of SEQ ID NO: 27;
the VH of SEQ ID NO: 23 and the VL of SEQ ID NO: 28;
the VH of SEQ ID NO: 23 and the VL of SEQ ID NO: 29; or
the VH of SEQ ID NO: 23 and the VL of SEQ ID NO: 30.

The invention also provides an isolated polynucleotide encoding the polypeptide of SEQ ID NOs: SEQ ID NOs: 65, 66, 67, 68, 69, 70, 71, 72, 73 or 74.

The invention also provides an isolated polynucleotide encoding the polypeptide of SEQ ID NO: 65.

The invention also provides an isolated polynucleotide encoding the polypeptide of SEQ ID NO: 66.

The invention also provides an isolated polynucleotide encoding the polypeptide of SEQ ID NO: 67.

The invention also provides an isolated polynucleotide encoding the polypeptide of SEQ ID NO: 68.

The invention also provides an isolated polynucleotide encoding the polypeptide of SEQ ID NO: 69.

The invention also provides an isolated polynucleotide encoding the polypeptide of SEQ ID NO: 70.

The invention also provides an isolated polynucleotide encoding the polypeptide of SEQ ID NO: 71.

The invention also provides an isolated polynucleotide encoding the polypeptide of SEQ ID NO: 72.

The invention also provides an isolated polynucleotide encoding the polypeptide of SEQ ID NO: 73.

The invention also provides an isolated polynucleotide encoding the polypeptide of SEQ ID NO: 74.

Some embodiments of the disclosure also provide an isolated or purified nucleic acid comprising a polynucleotide which is complementary to the polynucleotides encoding the CD3ε binding proteins of the disclosure or polynucleotides which hybridize under stringent conditions to the polynucleotides encoding the CD3ε binding proteins of the disclosure.

The polynucleotides which hybridize under stringent conditions may hybridize under high stringency conditions. By "high stringency conditions" is meant that the polynucleotide specifically hybridizes to a target sequence (the nucleotide sequence of any of the nucleic acids described herein) in an amount that is detectably stronger than non-specific hybridization. High stringency conditions include conditions which would distinguish a polynucleotide with an exact complementary sequence, or one containing only a few scattered mismatches from a random sequence that happened to have a few small regions (e.g., 3-12 bases) that matched the nucleotide sequence. Such small regions of complementarity are more easily melted than a full-length complement of 14-17 or more bases, and high stringency hybridization makes them easily distinguishable. Relatively high stringency conditions would include, for example, low salt and/or high temperature conditions, such as provided by about 0.02-0.1 M NaCl or the equivalent, at temperatures of about 50-70° C. Such high stringency conditions tolerate little, if any, mismatch between the nucleotide sequence and the template or target strand. It is generally appreciated that conditions can be rendered more stringent by the addition of increasing amounts of formamide.

The polynucleotide sequences of the disclosure may be operably linked to one or more regulatory elements, such as a promoter or enhancer, that allow expression of the nucleotide sequence in the intended host cell. The polynucleotide may be a cDNA. The promoter bay be a strong, weak, tissue-specific, inducible or developmental-specific promoter. Exemplary promoters that may be used are hypoxanthine phosphoribosyl transferase (HPRT), adenosine deaminase, pyruvate kinase, beta-actin, human myosin, human hemoglobin, human muscle creatine, and others. In addition, many viral promoters function constitutively in eukaryotic cells and are suitable for use with the described embodiments. Such viral promoters include Cytomegalovirus (CMV) immediate early promoter, the early and late promoters of SV40, the Mouse Mammary Tumor Virus (MMTV) promoter, the long terminal repeats (LTRs) of Maloney leukemia virus, Human Immunodeficiency Virus (HIV), Epstein Barr Virus (EBV), Rous Sarcoma Virus (RSV), and other retroviruses, and the thymidine kinase promoter of Herpes Simplex Virus. Inducible promoters such as the metallothionein promoter, tetracycline-inducible promoter, doxycycline-inducible promoter, promoters that contain one or more interferon-stimulated response elements (ISRE) such as protein kinase R 2',5'-oligoadenylate synthetases, Mx genes, ADAR1, and the like may also be sued.

The invention also provides a vector comprising the polynucleotide of the invention. The disclosure also provide an expression vector comprising the polynucleotide of the invention. Such vectors may be plasmid vectors, viral vectors, vectors for baculovirus expression, transposon based vectors or any other vector suitable for introduction of the synthetic polynucleotide of the invention into a given organism or genetic background by any means. Polynucleotides encoding the CD3ε binding proteins of the disclosure may be operably linked to control sequences in the expression vector(s) that ensure the expression of the CD3ε binding proteins. Such regulatory elements may include a transcriptional promoter, sequences encoding suitable mRNA ribosomal binding sites, and sequences that control the termination of transcription and translation. Expression vectors may also include one or more nontranscribed elements such as an origin of replication, a suitable promoter and enhancer linked to the gene to be expressed, other 5' or 3' flanking nontranscribed sequences, 5' or 3' nontranslated sequences (such as necessary ribosome binding sites), a polyadenylation site, splice donor and acceptor sites, or transcriptional termination sequences. An origin of replication that confers the ability to replicate in a host may also be incorporated.

The expression vectors can comprise naturally-occurring or non-naturally-occurring internucleotide linkages, or both types of linkages. The non-naturally occurring or altered nucleotides or internucleotide linkages do not hinder the transcription or replication of the vector.

Once the vector has been incorporated into the appropriate host, the host is maintained under conditions suitable for high level expression of the CD3ε binding proteins of the disclosure encoded by the incorporated polynucleotides. The transcriptional and translational control sequences in expression vectors to be used in transforming vertebrate cells may be provided by viral sources. Exemplary vectors may be constructed as described by Okayama and Berg, 3 *Mol. Cell. Biol.* 280 (1983).

Vectors of the disclosure may also contain one or more Internal Ribosome Entry Site(s) (IRES). Inclusion of an IRES sequence into fusion vectors may be beneficial for enhancing expression of some proteins. In other embodiments, the vector system will include one or more polyadenylation sites (e.g., SV40), which may be upstream or downstream of any of the aforementioned nucleic acid sequences. Vector components may be contiguously linked or arranged in a manner that provides optimal spacing for expressing the gene products (i.e., by the introduction of "spacer" nucleotides between the ORFs) or positioned in another way. Regulatory elements, such as the IRES motif, may also be arranged to provide optimal spacing for expression.

Vectors of the disclosure may be circular or linear. They may be prepared to contain a replication system functional in a prokaryotic or eukaryotic host cell. Replication systems can be derived, e.g., from ColE1, SV40, 2μ plasmid, λ, bovine papilloma virus, and the like.

The recombinant expression vectors can be designed for either transient expression, for stable expression, or for both. Also, the recombinant expression vectors can be made for constitutive expression or for inducible expression.

Further, the recombinant expression vectors can be made to include a suicide gene. As used herein, the term "suicide gene" refers to a gene that causes the cell expressing the suicide gene to die. The suicide gene can be a gene that confers sensitivity to an agent, e.g., a drug, upon the cell in which the gene is expressed, and causes the cell to die when the cell is contacted with or exposed to the agent. Suicide genes are known in the art and include, for example, the Herpes Simplex Virus (HSV) thymidine kinase (TK) gene, cytosine deaminase, purine nucleoside phosphoryl The vectors may also comprise selection markers, which are well known in the art. Selection markers include positive and negative selection marker. Marker genes include biocide resistance, e.g., resistance to antibiotics, heavy metals, etc., complementation in an auxotrophic host to provide prototrophy, and the like. Exemplary marker genes include antibiotic resistance genes (e.g., neomycin resistance gene, a hygromycin resistance gene, a kanamycin resistance gene, a tetracycline resistance gene, a penicillin resistance gene, histidinol resistance gene, histidinol×resistance gene), glutamine synthase genes, HSV-TK, HSV-TK derivatives for ganciclovir selection, or bacterial purine nucleoside phosphorylase gene for 6-methylpurine selection (Gadi et al., 7 Gene Ther. 1738-1743 (2000)). A nucleic acid sequence encoding a selection marker or the cloning site may be upstream or downstream of a nucleic acid sequence encoding a polypeptide of interest or cloning site.

Exemplary vectors that may be used are Bacterial: pBs, phagescript, PsiX174, pBluescript SK, pBs KS, pNH8a, pNH16a, pNH18a, pNH46a (Stratagene, La Jolla, Calif., USA); pTrc99A, pKK223-3, pKK233-3, pDR540, and pRIT5 (Pharmacia, Uppsala, Sweden). Eukaryotic: pWL-neo, pSV2cat, pOG44, PXR1, pSG (Stratagene) pSVK3, pBPV, pMSG and pSVL (Pharmacia), pEE6.4 (Lonza) and pEE12.4 (Lonza). Additional vectors include the pUC series (Fermentas Life Sciences, Glen Burnie, Md.), the pBluescript series (Stratagene, LaJolla, Calif.), the pET series (Novagen, Madison, Wis.), the pGEX series (Pharmacia Biotech, Uppsala, Sweden), and the pEX series (Clontech, Palo Alto, Calif.). Bacteriophage vectors, such as λGT10, λGT11, λEMBL4, and λNM1149, λZapII (Stratagene) can be used. Exemplary plant expression vectors include pBI01, pBI01.2, pBI121, pBI101.3, and pBIN19 (Clontech). Exemplary animal expression vectors include pEUK-Cl, pMAM, and pMAMneo (Clontech). The expression vector may be a viral vector, e.g., a retroviral vector, e.g., a gamma retroviral vector.ase, and nitroreductase.

In other embodiments, the vector comprises the polynucleotide encoding the VH of SEQ ID NO: 23.

In other embodiments, the vector comprises the polynucleotide encoding the VL of SEQ ID NOs: 24, 27, 28, 29 or 30.

In other embodiments, the vector comprises the polynucleotide encoding the VL of SEQ ID NO: 24.

In other embodiments, the vector comprises the polynucleotide encoding the VL of SEQ ID NO: 27.

In other embodiments, the vector comprises the polynucleotide encoding the VL of SEQ ID NO: 28.

In other embodiments, the vector comprises the polynucleotide encoding the VL of SEQ ID NO: 29.

In other embodiments, the vector comprises the polynucleotide encoding the VL of SEQ ID NO: 30.

In other embodiments, the vector comprises the polynucleotide encoding the VH of SEQ ID NO: 23 and the VL of SEQ ID NOs: 24, 27, 28, 29 or 30.

In other embodiments, the vector comprises the polynucleotide encoding the VH of SEQ ID NO: 23 and the VL of SEQ ID NO: 24;
the VH of SEQ ID NO: 23 and the VL of SEQ ID NO: 27;
the VH of SEQ ID NO: 23 and the VL of SEQ ID NO: 28;
the VH of SEQ ID NO: 23 and the VL of SEQ ID NO: 29; or
the VH of SEQ ID NO: 23 and the VL of SEQ ID NO: 30.

In other embodiments, the vector comprises the polynucleotide encoding the polypeptide of SEQ ID NOs: SEQ ID NOs: 65, 66, 67, 68, 69, 70, 71, 72, 73 or 74.

In other embodiments, the vector comprises the polynucleotide encoding the polypeptide of SEQ ID NO: 65.

In other embodiments, the vector comprises the polynucleotide encoding the polypeptide of SEQ ID NO: 66.

In other embodiments, the vector comprises the polynucleotide encoding the polypeptide of SEQ ID NO: 67.

In other embodiments, the vector comprises the polynucleotide encoding the polypeptide of SEQ ID NO: 68.

In other embodiments, the vector comprises the polynucleotide encoding the polypeptide of SEQ ID NO: 69.

In other embodiments, the vector comprises the polynucleotide encoding the polypeptide of SEQ ID NO: 70.

In other embodiments, the vector comprises the polynucleotide encoding the polypeptide of SEQ ID NO: 71.

In other embodiments, the vector comprises the polynucleotide encoding the polypeptide of SEQ ID NO: 72.

In other embodiments, the vector comprises the polynucleotide encoding the polypeptide of SEQ ID NO: 73.

In other embodiments, the vector comprises the polynucleotide encoding the polypeptide of SEQ ID NO: 74.

The invention also provides for a host cell comprising one or more vectors of the invention. "Host cell" refers to a cell into which a vector has been introduced. It is understood that the term host cell is intended to refer not only to the particular subject cell but to the progeny of such a cell, and also to a stable cell line generated from the particular subject cell. Because certain modifications may occur in succeeding generations due to either mutation or environmental influences, such progeny may not be identical to the parent cell, but are still included within the scope of the term "host cell" as used herein. Such host cells may be eukaryotic cells, prokaryotic cells, plant cells, or archaeal cells. *Escherichia coli*, bacilli, such as *Bacillus subtilis*, and other enterobacteriaceae, such as *Salmonella, Serratia*, and various *Pseudomonas* species are examples of prokaryotic host cells. Other microbes, such as yeast, are also useful for expression. *Saccharomyces* (e.g., *S. cerevisiae*) and *Pichia* are examples of suitable yeast host cells. Exemplary eukaryotic cells may be of mammalian, insect, avian or other animal origins. Mammalian eukaryotic cells include immortalized cell lines such as hybridomas or myeloma cell lines such as SP2/0 (American Type Culture Collection (ATCC®), Manassas, VA, CRL-1581), NS0 (European Collection of Cell Cultures (ECACC), Salisbury, Wiltshire, UK, ECACC No. 85110503), FO (ATCC® CRL-1646) and Ag653 (ATCC® CRL-1580) murine cell lines. An exemplary human myeloma cell line is U266 (ATTC® CRL-TIB-196). Other useful cell lines include those derived from Chinese Hamster Ovary (CHO) cells such as CHO-K1SV (Lonza Biologics, Walkersville, MD), CHO-K1 (ATCC® CRL-61) or DG44.

The disclosure also provides a method of producing the CD3ε binding protein of the disclosure comprising culturing the host cell of the disclosure in conditions that the CD3ε binding protein is expressed, and recovering the CD3ε binding protein produced by the host cell. Methods of making proteins and purifying them are known. Once synthesized (either chemically or recombinantly), the CD3ε binding proteins may be purified according to standard procedures, including ammonium sulfate precipitation, affinity columns, column chromatography, high performance liquid chromatography (HPLC) purification, gel electrophoresis, and the like (see generally Scopes, Protein Purification (Springer-Verlag, N.Y., (1982)). A subject protein may be substantially pure, e.g., at least about 80% to 85% pure, at least about 85% to 90% pure, at least about 90% to 95% pure, or at least about 98% to 99%, or more, pure, e.g., free from contaminants such as cell debris, macromolecules, etc. other than the subject protein The polynucleotides encoding the CD3ε binding proteins of the disclosure may be incorporated into vectors using standard molecular biology methods. Host cell transformation, culture, antibody expression and purification are done using well known methods.

Modified nucleotides may be used to generate the polynucleotides of the disclosure. Exemplary modified nucleotides are 5-fluorouracil, 5-bromouracil, 5-chlorouracil, 5-iodouracil, hypoxanthine, xanthine, 4-acetylcytosine, 5-(carboxyhydroxymethyl) uracil, carboxymethylaminomethyl-2-thiouridine, 5-carboxymethylaminomethyluracil, dihydrouracil, $N^6$-substituted adenine, 7-methylguanine, 5-methylaminomethyluracil, 5-methoxyaminomethyl-2-thiouracil, beta-D-mannosylqueosine, 5"-methoxycarboxymethyluracil, 5-methoxyuracil, 2-methylthio-$N^6$-isopentenyladenine, uracil-5-oxyacetic acid (v), wybutoxosine, pseudouracil, queuosine, beta-D-galactosylqueosine, inosine, $N^6$-isopentenyladenine, 1-methylguanine, 1-methylinosine, 2,2-dimethylguanine, 2-methyladenine, 2-methylguanine, 3-methylcytosine, 5-methylcytosine, 2-thiocytosine, 5-methyl-2-thiouracil, 2-thiouracil, 4-thiouracil, 5-methyluracil, uracil-5-oxyacetic acid methylester, 3-(3-amino-3-N-2-carboxypropyl) uracil, and 2,6-diaminopurine.

Pharmaceutical Compositions/Administration

The disclosure also provides a pharmaceutical composition comprising the CD3ε binding protein of the disclosure and a pharmaceutically acceptable carrier.

The disclosure also provides a pharmaceutical composition comprising the antigen binding domain that binds CD3ε of the disclosure and a pharmaceutically acceptable carrier.

The disclosure also provides a pharmaceutical composition comprising the protein comprising the antigen binding domain that binds CD3ε of the disclosure and a pharmaceutically acceptable carrier.

The disclosure also provides a pharmaceutical composition comprising the multispecific protein comprising the antigen binding domain that binds CD3ε of the disclosure and a pharmaceutically acceptable carrier.

The disclosure also provides a pharmaceutical composition comprising the multispecific protein comprising the antigen binding domain that binds CD3ε and antigen binding domain that binds a tumor antigen of the disclosure and a pharmaceutically acceptable carrier.

For therapeutic use, the CD3ε binding protein of the disclosure may be prepared as pharmaceutical compositions containing an effective amount of the antibody as an active ingredient in a pharmaceutically acceptable carrier. These solutions are sterile and generally free of particulate matter. They may be sterilized by conventional, well-known sterilization techniques (e.g., filtration). The compositions may contain pharmaceutically acceptable auxiliary substances as required to approximate physiological conditions such as pH adjusting and buffering agents, stabilizing, thickening, lubricating and coloring agents, etc.

The term "pharmaceutically acceptable," as used herein with regard to pharmaceutical compositions, means approved by a regulatory agency of the Federal or a state government or listed in the U.S. Pharmacopeia or other generally recognized pharmacopeia for use in animals and/or in humans.

Methods of Treatment and Uses

The disclosure also provides the bispecific or multispecific protein comprising a first antigen biding domain that specifically binds CD3ε and a second antigen biding domain that specifically binds a second antigen of the disclosure for use in therapy.

The disclosure also provides the bispecific or multispecific protein comprising a first antigen biding domain that specifically binds CD3ε and a second antigen biding domain that specifically binds a second antigen of the disclosure for use in treating a cell proliferative disorder.

The disclosure also provides the bispecific or multispecific protein comprising a first antigen biding domain that specifically binds CD3ε and a second antigen biding domain that specifically binds a second antigen of the disclosure for use in treating cancer.

The disclosure also provides the bispecific or multispecific protein comprising a first antigen biding domain that specifically binds CD3ε and a second antigen biding domain that specifically binds a second antigen of the disclosure for use in the manufacture of a medicament for treating cancer.

In one aspect, the disclosure relates generally to the treatment of a subject at risk of developing cancer. The invention also includes treating a malignancy in which chemotherapy and/or immunotherapy results in significant immunosuppression in a subject, thereby increasing the risk of the subject developing cancer.

The disclosure also provides a method of treating a noncancerous condition in a subject at risk of developing a cancerous condition, comprising administering the antigen binding domain that bind CD3ε of the disclosure to the subject to treat the noncancerous condition.

The disclosure also provides a method of treating a noncancerous condition in a subject at risk of developing a cancerous condition, comprising administering the protein comprising the antigen binding domain that bind CD3ε of the disclosure to the subject to treat the noncancerous condition.

The disclosure also provides a method of treating a noncancerous condition in a subject at risk of developing a cancerous condition, comprising administering the multispecific protein comprising the antigen binding domain that bind CD3ε of the disclosure to the subject to treat the noncancerous condition.

The disclosure also provides a method of treating a noncancerous condition in a subject at risk of developing a cancerous condition, comprising administering the immunoconjugate of the disclosure to the subject to treat the noncancerous condition.

The disclosure also provides a method of treating a noncancerous condition in a subject at risk of developing a cancerous condition, comprising administering the pharmaceutical composition of the disclosure to the subject to treat the noncancerous condition.

The disclosure also provides a method of treating cancer in a subject, comprising administering a therapeutically effective amount of the multispecific protein comprising the antigen binding domain that binds CD3ε to the subject to treat the cancer, wherein the antigen binding domain that bind CD3ε comprises the VH of SEQ ID NO: 23 and the VL of SEQ ID NO: 24;
the VH of SEQ ID NO: 23 and the VL of SEQ ID NO: 27;
the VH of SEQ ID NO: 23 and the VL of SEQ ID NO: 28;
the VH of SEQ ID NO: 23 and the VL of SEQ ID NO: 29; or
the VH of SEQ ID NO: 23 and the VL of SEQ ID NO: 30.

The disclosure also provides a method of treating cancer in a subject, comprising administering a therapeutically effective amount of the multispecific protein comprising the antigen binding domain that binds CD3ε to the subject to treat the cancer, wherein the antigen binding domain that binds CD3ε comprises the amino acid sequence of SEQ ID NOs: 65, 66, 67, 68, 69, 70, 71, 72, 73, or 74.

A further aspect of the disclosure is a method of treating a cell proliferative disorder in a subject in need thereof, the method comprising administering to the subject a therapeutically effective amount of the bispecific or multispecific protein comprising a first antigen biding domain that specifically binds CD3ε and a second antigen biding domain that specifically binds a second antigen of the disclosure. In other embodiments, the bispecific or multispecific protein comprising a first antigen biding domain that specifically binds CD3ε and a second antigen biding domain that specifically binds a second antigen of the disclosure, is administered to the subject.

In any of the preceding uses or methods, the cell proliferative disorder is cancer. In other embodiments, the cancer is selected from the group consisting of esophageal cancer, stomach cancer, small intestine cancer, large intestine cancer, colorectal cancer, breast cancer, non-small cell lung cancer, non-Hodgkin's lymphoma (NHL), B cell lymphoma, B cell leukemia, multiple myeloma, renal cancer, prostate cancer, liver cancer, head and neck cancer, melanoma, ovarian cancer, mesothelioma, glioblastoma, germinal-center B-cell-like (GCB) DLBCL, activated B-cell-like (ABC) DLBCL, follicular lymphoma (FL), mantle cell lymphoma (MCL), acute myeloid leukemia (AML), chronic lymphoid leukemia (CLL), marginal zone lymphoma (MZL), small lymphocytic leukemia (SLL), lymphoplasmacytic lymphoma (LL), Waldenstrom macroglobulinemia (WM), central nervous system lymphoma (CNSL), Burkitt's lymphoma (BL), B-cell prolymphocytic leukemia, Splenic marginal zone lymphoma, Hairy cell leukemia, Splenic lymphoma/leukemia, unclassifiable, Splenic diffuse red pulp small B-cell lymphoma, Hairy cell leukemia variant, Waldenstrom macroglobulinemia, Heavy chain diseases, Plasma cell myeloma, Solitary plasmacytoma of bone, Extraosseous plasmacytoma, Extranodal marginal zone lymphoma of mucosa-associated lymphoid tissue (MALT lymphoma), Nodal marginal zone lymphoma, Pediatric nodal marginal zone lymphoma, Pediatric follicular lymphoma, Primary cutaneous follicle centre lymphoma, T-cell/histiocyte rich large B-cell lymphoma, Primary DLBCL of the CNS, Primary cutaneous DLBCL, leg type, EBV-positive DLBCL of the elderly, DLBCL associated with chronic inflammation, Lymphomatoid granulomatosis, Primary mediastinal (thymic) large B-cell lymphoma. Intravascular large B-cell lymphoma, ALK-positive large B-cell lymphoma, Plasmablastic lymphoma, Large B-cell lymphoma arising in HHV8-associated multicentric Castleman disease, Primary effusion lymphoma: B-cell lymphoma, unclassifiable, with features intermediate between diffuse large B-cell lymphoma and Burkitt lymphoma, and B-cell lymphoma, unclassifiable, with features intermediate between diffuse large B-cell lymphoma, classical Hodgkin lymphoma and light chain amyloidosis.

In other embodiments, the cancer is esophageal cancer. In other embodiments, the cancer is an adenocarcinoma, for example, a metastatic adenocarcinoma (e.g., a colorectal adenocarcinoma, a gastric adenocarcinoma, or a pancreatic adenocarcinoma).

In another aspect, the disclosure features a kit comprising: (a) a composition comprising any one of the preceding the bispecific or multispecific protein comprising a first antigen biding domain that specifically binds CD3ε and a second antigen biding domain that specifically binds a second antigen of the disclosure and (b) a package insert comprising instructions for administering the composition to a subject to treat or delay progression of a cell proliferative disorder.

In any of the preceding uses or methods, the subject can be a human.

Combination Therapies

The CD3ε binding proteins of the disclosure may be administered in combination with at least one additional therapeutics.

In other embodiments, the delivery of one treatment is still occurring when the delivery of the second begins, so that there is overlap in terms of administration. This is sometimes referred to herein as "simultaneous" or "concurrent delivery". In other embodiments, the delivery of one treatment ends before the delivery of the other treatment begins. In some embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In other embodiments, delivery is such that the reduction in a symptom, or other parameter related to the disorder is greater than what would be observed with one treatment delivered in the absence of the other. The delivery can be such that an effect of the first treatment delivered is still detectable when the second is delivered.

The CD3ε binding proteins described herein and the at least one additional therapeutic agent can be administered simultaneously, in the same or in separate compositions, or sequentially. For sequential administration, the CD3ε binding proteins described herein can be administered first, and the additional agent can be administered second, or the order of administration can be reversed.

Embodiments

This invention provides the following non-limiting embodiments.

1. An isolated protein comprising an antigen binding domain that binds to cluster of differentiation 3ε (CD3ε), wherein the antigen binding domain that binds CD3ε comprises:
   a. a heavy chain complementarity determining region (HCDR) 1, a HCDR2 and a HCDR3 of a heavy chain variable region (VH) of SEQ ID NO: 23 and a light chain complementarity determining region (LCDR) 1, a LCDR2 and a LCDR3 of a light chain variable region (VL) of SEQ ID NO: 24;
   b. the HCDR1, the HCDR2 and the HCDR3 of the VH of SEQ ID NO: 23 and the LCDR1, the LCDR2 and the LCDR3 of the VL of SEQ ID NO: 27;
   c. the HCDR1, the HCDR2 and the HCDR3 of the VH of SEQ ID NO: 23 and the LCDR1, the LCDR2 and the LCDR3 of the VL of SEQ ID NO: 28;
   d. the HCDR1, the HCDR2 and the HCDR3 of the VH of SEQ ID NO: 23 and the LCDR1, the LCDR2 and the LCDR3 of the VL of SEQ ID NO: 29; or
   e. the HCDR1, the HCDR2 and the HCDR3 of the VH of SEQ ID NO: 23 and the LCDR1, the LCDR2 and the LCDR3 of the VL of SEQ ID NO: 30.
2. The isolated protein of embodiment 1, comprising the HCDR1, the HCDR2, the HCDR3, the LCDR1, the LCDR2 and the LCDR3 of
   a. SEQ ID NOs: 6, 7, 8, 9, 10, and 11, respectively;
   b. SEQ ID NOs:12, 13, 14, 15, 16, and 17, respectively; or
   c. SEQ ID NOs: 18, 19, 20, 21, 16, and 22, respectively.
3. The isolated protein of embodiment 1 or 2, wherein the antigen binding domain that binds CD3ε is a scFv, a (scFv)2, a Fv, a Fab, a F(ab')2, a Fd, a dAb or a VHH.
4. The isolated protein of embodiment 3, wherein the antigen binding domain that binds CD3ε is the Fab.
5. The isolated protein of embodiment 3, wherein the antigen binding domain that binds CD3ε is the VHH.
6. The isolated protein of embodiment 3, wherein the antigen binding domain that binds CD3ε is the scFv.
7. The isolated protein of embodiment 6, wherein the scFv comprises, from the N- to C-terminus, a VH, a first linker (L1) and a VL (VH-L1-VL) or the VL, the L1 and the VH (VL-L1-VH).
8. The isolated protein of embodiment 7, wherein the L1 comprises
   a. about 5-50 amino acids;
   b. about 5-40 amino acids;
   c. about 10-30 amino acids; or
   d. about 10-20 amino acids.
9. The isolated protein of embodiment 7, wherein the L1 comprises an amino acid sequence of SEQ ID NOs: 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, or 64.
10. The isolated protein of embodiment 9 wherein the L1 comprises the amino acid sequence of SEQ ID NO: 31, 37, or 64.
11. The isolated protein of any one of embodiments 1-10, wherein the antigen binding domain that binds CD3ε comprises the VH of SEQ ID NOs: 23 and the VL of SEQ ID NOs: 24, 27, 28, 29 or 30.
12. The isolated protein of embodiment 11, wherein the antigen binding domain that binds CD3ε comprises:
    a. the VH of SEQ ID NO: 23 and the VL of SEQ ID NO: 24;
    b. the VH of SEQ ID NO: 23 and the VL of SEQ ID NO: 27;
    c. the VH of SEQ ID NO: 23 and the VL of SEQ ID NO: 28;
    d. the VH of SEQ ID NO: 23 and the VL of SEQ ID NO: 29; or
    e. the VH of SEQ ID NO: 23 and the VL of SEQ ID NO: 30.
13. The isolated protein of any one of embodiments 1-12, wherein the antigen binding domain that binds CD3ε comprises the amino acid sequence of SEQ ID NOs: 65, 66, 67, 68, 69, 70, 71, 72, 73, or 74.
14. An isolated protein comprising an antigen binding domain that binds CD3ε, wherein the antigen binding domain that binds CD3ε comprises a heavy chain variable region (VH) of SEQ ID NO: 23 and a light chain variable region (VL) of SEQ ID NO: 103.

15. The isolated protein of embodiment 14, wherein the antigen binding domain that binds CD3ε is a scFv, a (scFv)2, a Fv, a Fab, a F(ab')2, a Fd, a dAb or a VHH.

16. The isolated protein of embodiment 15, wherein the antigen binding domain that binds CD3ε is the Fab.

17. The isolated protein of embodiment 15, wherein the antigen binding domain that binds CD3ε is the VHH.

18. The isolated protein of embodiment 15, wherein the antigen binding domain that binds CD3ε is the scFv.

19. The isolated protein of embodiment 18, wherein the scFv comprises, from the N- to C-terminus, a VH, a first linker (L1) and a VL (VH-L1-VL) or the VL, the L1 and the VH (VL-L1-VH).

20. The isolated protein of embodiment 19, wherein the L1 comprises
 a. about 5-50 amino acids;
 b. about 5-40 amino acids;
 c. about 10-30 amino acids; or
 d. about 10-20 amino acids.

21. The isolated protein of embodiment 20, wherein the L1 comprises an amino acid sequence of SEQ ID NOs: 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, or 64.

22. The isolated protein of embodiment 21, wherein the L1 comprises the amino acid sequence of SEQ ID NO: 31, 37, or 64.

23. The isolated protein of embodiment 14-22, wherein the antigen binding domain that binds CD3ε comprises the VH of SEQ ID NO: 23 and the VL of SEQ ID NO: 24, 27, 28, 29, or 30.

24. The isolated protein of embodiment 23, wherein the antigen binding domain that binds CD3ε comprises:
 a. the VH of SEQ ID NO: 23 and the VL of SEQ ID NO: 24;
 b. the VH of SEQ ID NO: 23 and the VL of SEQ ID NO: 27;
 c. the VH of SEQ ID NO: 23 and the VL of SEQ ID NO: 28;
 d. the VH of SEQ ID NO: 23 and the VL of SEQ ID NO: 29; or
 e. the VH of SEQ ID NO: 23 and the VL of SEQ ID NO: 30;

25. The isolated protein of any one of embodiments 1-24, wherein the isolated protein is a multispecific protein.

26. The isolated protein of embodiment 25, wherein the multispecific protein is a bispecific protein.

27. The isolated protein of embodiment 25, wherein the multispecific protein is a trispecific protein.

28. The isolated protein of any one of embodiments 1-27, further comprising an immunoglobulin (Ig) constant region or a fragment of the Ig constant region thereof.

29. The isolated protein of embodiment 28, wherein the fragment of the Ig constant region comprises a Fc region.

30. The isolated protein of embodiment 28, wherein the fragment of the Ig constant region comprises a CH2 domain.

31. The isolated protein of embodiment 28, wherein the fragment of the Ig constant region comprises a CH3 domain.

32. The isolated protein of embodiment 28, wherein the fragment of the Ig constant region comprises the CH2 domain and the CH3 domain.

33. The isolated protein of embodiment 28, wherein the fragment of the Ig constant region comprises at least portion of a hinge, the CH2 domain and the CH3 domain.

34. The isolated protein of embodiment 28, wherein the fragment of the Ig constant region comprises a hinge, the CH2 domain and the CH3 domain.

35. The isolated protein of any one of embodiments 28-34, wherein the antigen binding domain that binds CD3ε is conjugated to the N-terminus of the Ig constant region or the fragment of the Ig constant region.

36. The isolated protein of any one of embodiments 28-34, wherein the antigen binding domain that binds CD3ε is conjugated to the C-terminus of the Ig constant region or the fragment of the Ig constant region.

37. The isolated protein of any one of embodiments 28-36, wherein the antigen binding domain that binds CD3ε is conjugated to the Ig constant region or the fragment of the Ig constant region via a second linker (L2).

38. The isolated protein of embodiment 37, wherein the L2 comprises the amino acid sequence of SEQ ID NOs: 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, or 64.

39. The isolated protein of any one of embodiments 28-38, wherein the multispecific protein comprises an antigen binding domain that binds an antigen other than CD3ε.

40. The multispecific antibody of embodiment 39, wherein the cell antigen is a tumor associated antigen.

41. The multispecific antibody of any one of embodiments 39-40, wherein the cell antigen is selected from the group consisting of kallikrein related peptidase 2 (hK2), human leukocyte antigen G (HLA-G), and Delta-like protein 3 (DLL3).

42. The isolated protein of any one of embodiments 28-41, wherein the Ig constant region or the fragment of the Ig constant region is an IgG1, an IgG2, an IgG3 or an IgG4 isotype.

43. The isolated protein of any one of embodiments 28-42, wherein the Ig constant region or the fragment of the Ig constant region comprises at least one mutation that results in reduced binding of the protein to a Fcγ receptor (FcγR).

44. The isolated protein of embodiment 43, wherein the at least one mutation that results in reduced binding of the protein to the FcγR is selected from the group consisting of F234A/L235A, L234A/L235A, L234A/L235A/D265S, V234A/G237A/P238S/H268A/V309L/A330S/P331S, F234A/L235A, S228P/F234A/L235A, N297A, V234A/G237A, K214T/E233P/L234V/L235A/G236-deleted/A327G/P331A/D365E/L358M, H268Q/V309L/A330S/P331S, S267E/L328F, L234F/L235E/D265A, L234A/L235A/G237A/P238S/H268A/A330S/P331S, S228P/F234A/L235A/G237A/P238S and S228P/F234A/L235A/G236-deleted/G237A/P238S, wherein residue numbering is according to the EU index.

45. The isolated protein of any one of embodiments 28-42, wherein the Ig constant region or the fragment of the Ig constant region comprises at least one mutation that results in enhanced binding of the protein to the FcγR.

46. The isolated protein of embodiment 45, wherein the at least one mutation that results in enhanced binding of the protein to the FcγR is selected from the group consisting of S239D/I332E, S298A/E333A/K334A, F243L/R292P/Y300L, F243L/R292P/Y300L/P396L, F243L/R292P/Y300L/V305I/P396L and G236A/S239D/I332E, wherein residue numbering is according to the EU index.

47. The isolated protein of any one of embodiments 43-46, wherein the FcγR is FcγRI, FcγRIIA, FcγRIIB or FcγRIII, or any combination thereof.

48. The isolated protein of any one of embodiments 28-47, wherein the Ig constant region or the fragment of the Ig constant region comprises at least one mutation that modulates a half-life of the protein.

49. The isolated protein of embodiment 48, wherein the at least one mutation that modulates the half-life of the protein is selected from the group consisting of H435A, P257I/N434H, D376V/N434H, M252Y/S254T/T256E/H433K/N434F, T308P/N434A and H435R, wherein residue numbering is according to the EU index.

50. The isolated protein of any one of the embodiments 28-49, wherein the protein comprises at least one mutation in a CH3 domain of the Ig constant region.

51. The isolated protein of embodiment 40, wherein the at least one mutation in the CH3 domain of the Ig constant region is selected from the group consisting of T350V, L351Y, F405A, Y407V, T366Y, T366W, T366L, F405W, K392L, T394W, T394S, Y407T, Y407A, T366S/L368A/Y407V, L351Y/F405A/Y407V, T366I/K392M/T394W, F405A/Y407V, T366L/K392M/T394W, T366L/K392L/T394W, L351Y/Y407A, T366A/K409F, L351Y/Y407A, L351Y/Y407V, T366V/K409F, T366A/K409F, T350V/L351Y/F405A/Y407V and T350V/T366L/K392L/T394W, wherein residue numbering is according to the EU index.

52. A pharmaceutical composition comprising the isolated protein of any one of embodiments 1-51 and a pharmaceutically acceptable carrier.

53. A polynucleotide encoding the isolated protein of any one of embodiments 1-51.

54. A vector comprising the polynucleotide of embodiment 53.

55. A host cell comprising the vector of embodiment 54.

56. A method of producing the isolated protein of any one of embodiments 1-51, comprising culturing the host cell of embodiment 55 in conditions that the protein is expressed, and recovering the protein produced by the host cell.

57. A method of treating a cancer in a subject, comprising administering a therapeutically effective amount of the isolated antibody of any one of embodiments 1-51 to the subject in need thereof to treat the cancer.

58. The method of embodiment 57, wherein the cancer is a solid tumor or a hematological malignancy.

59. The method of embodiment 58, wherein the solid tumor is a prostate cancer, a colorectal cancer, a gastric cancer, a clear cell renal carcinoma, a bladder cancer, a lung cancer, a squamous cell carcinoma, a glioma, a breast cancer, a kidney cancer, a neovascular disorder, a clear cell renal carcinoma (CCRCC), a pancreatic cancer, a renal cancer, a urothelial cancer or an adenocarcinoma to the liver.

60. The method of embodiment 58, wherein the hematological malignancy is acute myeloid leukemia (AML), myelodysplastic syndrome (MDS), acute lymphocytic leukemia (ALL), diffuse large B-cell lymphoma (DLBCL), chronic myeloid leukemia (CML) or blastic plasmacytoid dendritic cell neoplasm (DPDCN).

61. The method of any one of embodiments 57-60, wherein the antibody is administered in combination with a second therapeutic agent.

62. An anti-idiotypic antibody binding to the isolated protein of any one of embodiments 1-51.

63. An isolated protein comprising an antigen binding domain that binds to an epitope on CD3ε (SEQ ID NO: 1), wherein the epitope is a discontinuous epitope comprising the amino acid sequences of SEQ ID NO: 100, 101, and 102.

64. An isolated protein comprising an amino acid sequence selected from the group consisting of SEQ ID NOs: 75, 76, 717, 718, 79, 80, 81, 82, 83, and 84.

65. An isolated protein comprising an amino acid sequence selected from the group consisting of SEQ ID NOs: 747, 748, 77, 78, 749, 750, 751, 752, 753, and 754.

66. An isolated protein comprising an amino acid sequences of SEQ ID NO: 75.

67. An isolated protein comprising an amino acid sequences of SEQ ID NO: 76.

68. An isolated protein comprising an amino acid sequences of SEQ ID NO: 717.

69. An isolated protein comprising an amino acid sequences of SEQ ID NO: 718.

70. An isolated protein comprising an amino acid sequences of SEQ ID NO: 79.

71. An isolated protein comprising an amino acid sequences of SEQ ID NO: 80.

72. An isolated protein comprising an amino acid sequences of SEQ ID NO: 81.

73. An isolated protein comprising an amino acid sequences of SEQ ID NO: 82.

74. An isolated protein comprising an amino acid sequences of SEQ ID NO: 83.

75. An isolated protein comprising an amino acid sequences of SEQ ID NO: 84.

76. An isolated protein comprising an amino acid sequences of SEQ ID NO: 747.

77. An isolated protein comprising an amino acid sequences of SEQ ID NO: 748.

78. An isolated protein comprising an amino acid sequences of SEQ ID NO: 77.

79. An isolated protein comprising an amino acid sequences of SEQ ID NO: 78.

80. An isolated protein comprising an amino acid sequences of SEQ ID NO: 749.

81. An isolated protein comprising an amino acid sequences of SEQ ID NO: 750.

82. An isolated protein comprising an amino acid sequences of SEQ ID NO: 751.

83. An isolated protein comprising an amino acid sequences of SEQ ID NO: 752.

84. An isolated protein comprising an amino acid sequences of SEQ ID NO: 753.

85. An isolated protein comprising an amino acid sequences of SEQ ID NO: 754.

86. An isolated protein comprising an amino acid sequences of SEQ ID NOs: 85 and 86.

87. An isolated protein comprising an amino acid sequences of SEQ ID NOs: 85 and 88.

88. An isolated protein comprising an amino acid sequences of SEQ ID NOs: 85 and 90.

89. An isolated protein comprising an amino acid sequences of SEQ ID NOs: 85 and 92.

90. An isolated protein comprising an amino acid sequences of SEQ ID NOs: 85 and 94.

91. An isolated protein comprising an amino acid sequences of SEQ ID NOs: 719 and 86.

92. An isolated protein comprising an amino acid sequences of SEQ ID NOs: 719 and 88.
93. An isolated protein comprising an amino acid sequences of SEQ ID NOs: 719 and 90.
94. An isolated protein comprising an amino acid sequences of SEQ ID NOs: 719 and 92.
95. An isolated protein comprising an amino acid sequences of SEQ ID NOs: 719 and 94.

The following examples are provided to further describe some of the embodiments disclosed herein. The examples are intended to illustrate, not to limit, the disclosed embodiments.

EXAMPLES

Example 1. Generation and Characterization of Anti-CD3 mAbs

Anti-CD3 antibodies were generated using Ablexis® transgenic mouse platform. Ablexis® mice generate antibodies having human variable domains linked to human CH1 and CL domains, chimeric human/mouse hinge region, and mouse Fc regions. The two specific strains termed Ablexis® Kappa Mouse and Lambda Mouse strains lack specific mouse sequences and are described in WO11/123708 and WO2003000737.

Ablexis® mice were immunized with TRCW5 (SEQ ID NO: 3), including 13 Kappa mice and 12 Lambda mice. TRCW5 is comprised of the extracellular region of CD3δ fused by a 26 amino acid linker to the extracellular region of CD3ε as reported in Kim et al, JMP (2000) 302(4): 899-916. This polypeptide had at its C-terminus a human IgG1 Fc domain with a C-terminal Avi-tag used for site-specific biotinylation (Fairhead εHowarth, Methods Mol Biol (2015); 1266:171-184).

```
TRCW5 (SEQ ID NO: 3):
FKIPIEELEDRVFVNCNTSITWVEGTVGTLLSDITRLDLGKRILDPRGIY

RCNGTDIYKDKESTVQVHYRMGSADDAKKDAAKKDDAKKDDAKKDGSDGN

EEMGGITQTPYKVSISGTTVILTCPQYPGSEILWQHNDKNIGGDEDDKNI

GSDEDHLSLKEFSELEQSGYYVCYPRGSKPEDANFYLYLRARVSPPSPAP

ELLGGPSVFLFPPKPKDTLMISRTPEVTCVVVDVSHEDPEVKFNWYVDGV

EVHNAKTKPREEQYNSTYRVVSVLTVLHQDWLNGKEYKCKVSNKALPAPI

EKTISKAKGQPREPQVYTLPPSRDELTKNQVSLTCLVKGFYPSDIAVEWE

SNGQPENNYKTTPPVLDSDGSFFLYSKLTVDKSRWQQGNVFSCSVMHEAL

HNHYTQKSLSLSPGKGGGLNDIFEAQKIEWHE
```

Mice were immunized twice weekly for the duration of 7 weeks. On day 42, mice were boosted for hybridoma fusion by administration of 50 μg TRCW5 and 50 μg CD40 mAb spread over 8 sites, including 6 subcutaneous and 2 intradermal injections. For a final boost, mice received 20 μL injections of Jurkat cells, a T cell line which endogenously expresses the T cell receptor complex, including CD3ε (Schneider et al (1977) Int. J. Cancer, 19 (5): 621-6), at $4.74\times10^7$ cells/mL.

Lymph nodes and spleens were extracted from mice and fusions performed by cohorts. Lymph node cells were counted and combined in a 1:1 ratio with FO myeloma cells (ATCC® (CRL-1646)) and incubated for 10 d at 37° C. prior to antibody screening. Supernatants from hybridoma fusion cells were then assayed for binding to TRCW5 using TRCW5 either non-specifically immobilized on the plate (ELISA, Thermo cat. #34022) or by streptavidin conjugation to biotinylated-TRCW5 (SPARCL ELISA, Lumigen), according to manufacturers' instructions. ELISA assays were performed by coating plates with 0.5 ug/mL TRCW5 and 0.5 ug/mL HVEM-Fc (R&D cat. #365-HV) overnight @ 4° C. Plates were blocked by addition of 0.4% (w/v) bovine serum albumin (BSA) in phosphate-buffered saline (PBS) overnight @ 4° C. Plates were washed with 1×PBS supplemented with 0.02% (v/v) Tween® 20 (polysorbate 20). To each well, 50 μL of hybridoma supernatant was applied and incubated for 1 hr at room temperature. Bound antibody was detected by addition of goat anti-mouse IgG Fc conjugated to horseradish peroxidase (Jackson cat. #115-036-071) diluted 1:10,000 in blocking buffer followed by incubation for 30 min at room temperature. 3,3',5,5'-tetramethylbenzidine (TMB) substrate buffer (Thermo cat. #34022) was added at 25 uL/well and incubated for 10 min in the dark. Reactions were stopped by addition of 25 uL/well of 4 M $H_2SO_4$. Luminescence was read at 450 nm using BioTex® Epoch2 Microplate Reader. Hits were selected having signal at least 3-fold higher than background.

The two assay formats resulted in 426 hits (264 hits from ELISA, 194 from SPARCL ELISA, 70 hits were identified in both assays). Of these 426 initial hits, 49 ELISA and 32 SPARCL ELISA hits were confirmed. The hybridoma fusions corresponding to the positive binders were refed and tested for their abilities to bind Jurkat cells, using flow cytometry. The results suggested that three antibodies, including clone 003_F12, clone 036_E10 and clone 065_D03, showed significant binding to Jurkat cells, endogenously expressing CD3, based on mean fluorescence index (MFI, see Table 4). While clones 003_F12 and 036_E10 (from human kappa mice) were confirmed positive for human kappa light chain by ELISA, clone 065_D03 (from human lambda mouse) was negative for human lambda. The variable genes of these three clones were then sequenced.

TABLE 4

Mean fluorescence index (MFI) for binding of selected clones to Jurkat cells

| Clone ID | MFI (arbitrary units) |
|---|---|
| 003_F12 | 176147 |
| 036_E10 | 43133 |
| 065_D03 | 136269 |
| No Ab | 2075.61 |
| 10 nM UCHT1 | 89214.29 |

Figure 1A:
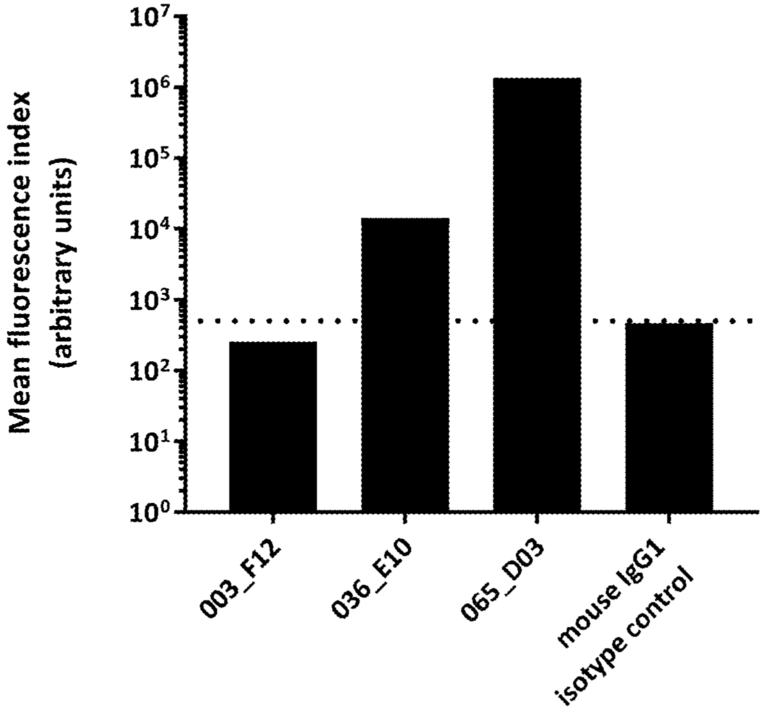
FIGS. 1A and 1B show binding of hybridoma supernatants to primary human T cells. Clone UCHT1 was used as a positive control (FIG. 1B); mouse IgG1 isotype (mIgG1) was used as a negative control.
Figure 1B:
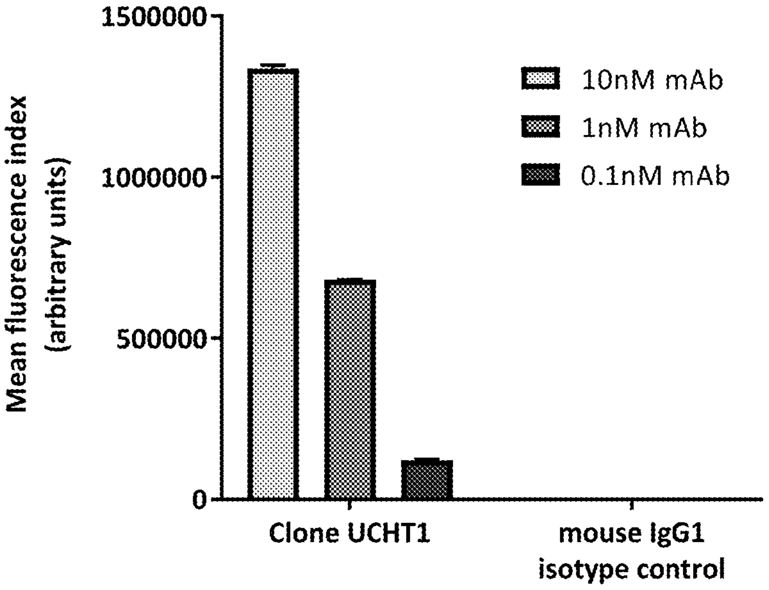

Next, these three clones were screened for their abilities to bind primary human and cyno T cells. Briefly, primary human and cyno pan T cells were resuspended at $1\times10^6$ cells/mL in flow staining buffer and cells were plated at 50,000 cells/well. To each well, 50 μL of hybridoma supernatant were added and the mixture was incubated on ice for 30 min. After incubation, 200 μL of staining buffer was added and cells were pelleted by centrifugation at 300×G for 5 min. Anti-mouse IgG conjugated to Alexa Fluor® 647 was added at 2 μg/mL in staining buffer in 50 uL total volume and incubated for 30 min on ice. 150 μL of staining buffer was added and cells were pelleted by centrifugation at 300×G for 5 min. Cells were resuspended in 30 μL of running buffer containing 1:1,000-diluted Sytox® green dead cell stain and run on iQue® Screener. Cells were gated on FCS vs SCS to eliminate debris. Singlets were gated on SCS-A vs SCS-H, and from singlet population, live cells were chosen using BL1 channel for low-negative with Sytox® green. CD3 binding was assessed by comparing test articles to negative control by RL1 (Alexa Fluor® 647) geomeans. In this assay, clone 065 D03 showed the highest cell binding signal (FIG. 1A-1B).

Thus, the variable region of the Clone 065_D03 was cloned into an IgG1 backbone, resulting in the antibody termed CD3B815 (sequences are shown in Table 5). CD3B815 was screened again for binding to Jurkat cells and showed positive binding to Jurkat cells.

TABLE 5

| CD3B815 amino acid sequences. | |
|---|---|
| **Protein** | **Amino acid sequences** |
| CD3B815 Heavy Chain (SEQ ID NO: 25) | EVQLVESGGGLVKPGGSLRLSCAASGFTFSRYNMNWVRQAPGKGLEWVS SISTSSNYIYYADSVKGRFTFSRDNAKNSLDLQMSGLRAEDTAIYYCTRGW GPFDYWGQGTLVTVSSASTKGPSVFPLAPSSKSTSGGTAALGCLVKDYFPE PVTVSWNSGALTSGVHTFPAVLQSSGLYSLSSVVTVPSSSLGTQTYICNVN HKPSNTKVDKKVEPKSCDKTHTCPPCPAPELLGGPSVFLFPPKPKDTLMISR TPEVTCVVVDVSHEDPEVKFNWYVDGVEVHNAKTKPREEQYNSTYRVVS VLTVLHQDWLNGKEYKCKVSNKALPAPIEKTISKAKGQPREPQVYTLPPS REEMTKNQVSLTCLVKGFYPSDIAVEWESNGQPENNYKTTPPVLDSDGSF FLYSKLTVDKSRWQQGNVFSCSVMHEALHNHYTQKSLSLSPGK |
| CD3B815 Light Chain (SEQ ID NO: 26) | DILLTQSPGILSVSPGERVSFSCRARQSIGTAIHWYQQRTNGSPRLLIKYASE SISGIPSRFSGSGSGTDFTLTINSVESEDIADYYCQQSNSWPYTFGGGTKLEI KRTVAAPSVFIFPPSDEQLKSGTASVVCLLNNFYPREAKVQWKVDNALQS GNSQESVTEQDSKDSTYSLSSTLTLSKADYEKHKVYACEVTHQGLSSPVT KSFNRGEC |

Humanization and scFv Formatting of CD3 Binding Domains

The light chain (LC) of the v-region of CD3B815 was humanized in scFv format. Briefly, the LC from CD3B815 was grafted onto the human IGHV3B21*54 germline and two positions (Y49K and L78V, according to Kabat numbering system) were identified for human to mouse back mutations. This resulted in variants, having either Y49K, L78V, or both Y49K and L78V. The LC from CD3B815 also contained an NS motif which presents a risk for deamidation at positions 92-93. Therefore several variants generated also contained N92G. These variants and associated mutations are described in Table 6, and the VH and the VL amino acid and nucleic acid sequences are shown in Tables 7 and 8. CDR sequences are shown in Tables 9-11.

TABLE 6

| Mutations in humanized scFv variants, defined according to Kabat numbering system. | | |
|---|---|---|
| **scFv identification** | **Description** | **VL mutations** |
| CD3W234 | CD3B815-HL-scFV, Contains mouse VL | none |
| CD3W238 | CDR of CD3B815 grafted into IGKV1D-39*01 | none |
| CD3W241 | CDR of CD3B815 grafted into IGKV1D-39*01 | L78V |
| CD3W242 | CDR of CD3B815 grafted into IGKV1D-39*01 | Y49K |
| CD3W243 | CDR of CD3B815 grafted into IGKV1D-39*01 | Y49K, L78V |
| CD3W244 | CDR of CD3B815 grafted into IGKV1D-39*01 | L78V, N92G |
| CD3W245 | CDR of CD3B815 grafted into IGKV1D-39*01 | Y49K, N92G |
| CD3W246 | CDR of CD3B815 grafted into IGKV1D-39*01 | Y49K, L78V, N92G |
| CD3W247 | CDR of CD3B815 grafted into IGKV1D-39*01 | N92G |
| CD3W248 | CD3B815-HL-scFV, Contains mouse VL | N92G |

TABLE 7

| VH and VL amino acid sequences of the humanized scFv variants. | | | | |
|---|---|---|---|---|
| **Binding domain name** | **VH amino acid Sequence** | **VH SEQ ID NO:** | **VL amino acid sequence** | **VL SEQ ID NO:** |
| CD3B815 | EVQLVESGGGLVKPGGSL RLSCAASGFTFSRYNMNW VRQAPGKGLEWVSSISTSS NYIYYADSVKGRFTFSRD NAKNSLDLQMSGLRAED TAIYYCTRGWGPFDYWG QGTLVTVSS | 23 | DILLTQSPGILSVSPGERV SFSCRARQSIGTAIHWYQ QRTNGSPRLLIKYASESIS GIPSRFSGSGSGTDFTLTI NSVESEDIADYYCQQSNS WPYTFGGGTKLEIK | 119 |
| CD3W244 | EVQLVESGGGLVKPGGSL RLSCAASGFTFSRYNMNW VRQAPGKGLEWVSSISTSS NYIYYADSVKGRFTFSRD NAKNSLDLQMSGLRAED TAIYYCTRGWGPFDYWG QGTLVTVSS | 23 | DIQMTQSPSSLSASVGDR VTITCRARQSIGTAIHWY QQKPGKAPKLLIYYASES ISGVPSRFSGSGSGTDFTL TISSVQPEDFATYYCQQS GSWPYTFGQGTKLEIK | 27 |
| CD3W245 | EVQLVESGGGLVKPGGSL RLSCAASGFTFSRYNMNW VRQAPGKGLEWVSSISTSS | 23 | DIQMTQSPSSLSASVGDR VTITCRARQSIGTAIHWY QQKPGKAPKLLIKYASES | 28 |

TABLE 7-continued

VH and VL amino acid sequences of the humanized scFv variants.

| Binding domain name | VH amino acid Sequence | VH SEQ ID NO: | VL amino acid sequence | VL SEQ ID NO: |
|---|---|---|---|---|
| | NYIYYADSVKGRFTFSRD NAKNSLDLQMSGLRAED TAIYYCTRGWGPFDYWG QGTLVTVSS | | ISGVPSRFSGSGSGTDFTL TISSLQPEDFATYYCQQS GSWPYTFGQGTKLEIK | |
| CD3W246 | EVQLVESGGGLVKPGGSL RLSCAASGFTFSRYNMNW VRQAPGKGLEWVSSISTSS NYIYYADSVKGRFTFSRD NAKNSLDLQMSGLRAED TAIYYCTRGWGPFDYWG QGTLVTVSS | 23 | DIQMTQSPSSLSASVGDR VTITCRARQSIGTAIHWY QQKPGKAPKLLIKYASES ISGVPSRFSGSGSGTDFTL TISSVQPEDFATYYCQQS GSWPYTFGQGTKLEIK | 24 |
| CD3W247 | EVQLVESGGGLVKPGGSL RLSCAASGFTFSRYNMNW VRQAPGKGLEWVSSISTSS NYIYYADSVKGRFTFSRD NAKNSLDLQMSGLRAED TAIYYCTRGWGPFDYWG QGTLVTVSS | 23 | DIQMTQSPSSLSASVGDR VTITCRARQSIGTAIHWY QQKPGKAPKLLIYYASES ISGVPSRFSGSGSGTDFTL TISSLQPEDFATYYCQQS GSWPYTFGQGTKLEIK | 29 |
| CD3W248 | EVQLVESGGGLVKPGGSL RLSCAASGFTFSRYNMNW VRQAPGKGLEWVSSISTSS NYIYYADSVKGRFTFSRD NAKNSLDLQMSGLRAED TAIYYCTRGWGPFDYWG QGTLVTVSS | 23 | DILLTQSPGILSVSPGERV SFSCRARQSIGTAIHWYQ QRTNGSPRLLIKYASESIS GIPSRFSGSGSGTDFTLTI NSVESEDIADYYCQQSGS WPYTFGGGTKLEIK | 30 |

TABLE 8

VH and VL nucleic acid sequences of the humanized scFv variants.

| Binding domain name | VH nucleic acid Sequence | VH SEQ ID NO: | VL nucleic acid sequence | VL SEQ ID NO: |
|---|---|---|---|---|
| CD3B815 | GAGGTGCAACTGGTGG AGTCTGGGGGAGGCCT GGTCAAGCCTGGGGGG TCCCTGAGACTCTCCTG TGCAGCCTCTGGATTCA CCTTCAGTAGATATAAC ATGAACTGGGTCCGCCA GGCTCCAGGGAAGGGG CTGGAGTGGGTCTCATC CATTAGTACTAGTAGTA ATTACATATACTACGCA GACTCAGTGAAGGGCC GATTCACCTTCTCCAGA GACAACGCCAAGAACT CACTGGATCTGCAAATG AGCGGCCTGAGAGCCG AGGACACGGCTATTTAT TACTGTACGAGAGGCTG GGGGCCTTTTGACTACT GGGGCCAGGGAACCCT GGTCACCGTCTCCTCA | 113 | GATATACTTCTTACCCAGA GTCCCGGCATCCTCTCCGT TAGCCCTGGGGAGAGAGT CTCATTCTCATGCCGAGCC AGACAGTCAATTGGTACC GCAATACACTGGTATCAA CAGCGGACCAATGGTTCT CCCCGACTTCTGATAAAGT ACGCATCAGAATCAATTA GTGGAATACCATCAAGAT TTAGTGGCTCAGGGAGTG GAACCGATTTTACTCTGAC CATCAACTCAGTGGAATCT GAGGACATTGCCGACTAC TACTGTCAACAAAGCAAT AGTTGGCCATATACCTTCG GAGGCGGAACTAAATTGG AGATAAAA | 120 |
| CD3W244 | GAGGTGCAACTGGTGG AGTCTGGGGGAGGCCT GGTCAAGCCTGGGGGG TCCCTGAGACTCTCCTG TGCAGCCTCTGGATTCA CCTTCAGTAGATATAAC ATGAACTGGGTCCGCCA GGCTCCAGGGAAGGGG CTGGAGTGGGTCTCATC CATTAGTACTAGTAGTA ATTACATATACTACGCA GACTCAGTGAAGGGCC | 113 | GACATCCAGATGACACAG TCACCTTCTAGTTTGTCTG CTTCTGTAGGCGACCGTGT AACTATCACCTGTCGAGCC CGTCAAAGTATTGGTACTG CCATTCACTGGTACCAACA AAAACCTGGCAAAGCTCC AAAACTCTTGATCTACTAT GCCTCCGAAAGCATATCA GGGGTCCCAAGCAGATTC TCAGGCAGTGGCAGTGGC ACTGACTTCACTCTCACCA | 114 |

TABLE 8-continued

VH and VL nucleic acid sequences of the humanized scFv variants.

| Binding domain name | VH nucleic acid Sequence | VH SEQ ID NO: | VL nucleic acid sequence | VL SEQ ID NO: |
|---|---|---|---|---|
| | GATTCACCTTCTCCAGA GACAACGCCAAGAACT CACTGGATCTGCAAATG AGCGGCCTGAGAGCCG AGGACACGGCTATTTAT TACTGTACGAGAGGCTG GGGGCCTTTTGACTACT GGGGCCAGGGAACCCT GGTCACCGTCTCCTCA | | TTTCTAGCGTGCAACCAGA GGACTTCGCCACTTATTAC TGCCAACAGTCAGGGAGC TGGCCCTACACCTTCGGCC AAGGTACAAAACTGGAGA TCAAA | |
| CD3W245 | GAGGTGCAACTGGTGG AGTCTGGGGGAGGCCT GGTCAAGCCTGGGGGG TCCCTGAGACTCTCCTG TGCAGCCTCTGGATTCA CCTTCAGTAGATATAAC ATGAACTGGGTCCGCCA GGCTCCAGGGAAGGGG CTGGAGTGGGTCTCATC CATTAGTACTAGTAGTA ATTACATATACTACGCA GACTCAGTGAAGGGCC GATTCACCTTCTCCAGA GACAACGCCAAGAACT CACTGGATCTGCAAATG AGCGGCCTGAGAGCCG AGGACACGGCTATTTAT TACTGTACGAGAGGCTG GGGGCCTTTTGACTACT GGGGCCAGGGAACCCT GGTCACCGTCTCCTCA | 113 | GACATACAAATGACACAA TCACCCTCTTCTCTTTCTG CAAGCGTTGGCGACCGTG TCACTATCACTTGTCGAGC CCGCCAGTCCATAGGTACT GCCATTCACTGGTATCAAC AGAAGCCTGGCAAGGCTC CCAAACTCCTGATTAAGTA TGCCAGCGAGAGCATTTC CGGCGTACCTTCAAGATTT TCCGGCTCCGGTAGTGGG ACAGATTTCACTCTCACTA TATCTAGCCTCCAACCAGA AGATTTCGCCACTTACTAC TGTCAACAATCAGGTTCAT GGCCTTACACTTTCGGCCA GGGGACAAAATTGGAGAT CAAG | 115 |
| CD3W246 | GAGGTGCAACTGGTGG AGTCTGGGGGAGGCCT GGTCAAGCCTGGGGGG TCCCTGAGACTCTCCTG TGCAGCCTCTGGATTCA CCTTCAGTAGATATAAC ATGAACTGGGTCCGCCA GGCTCCAGGGAAGGGG CTGGAGTGGGTCTCATC CATTAGTACTAGTAGTA ATTACATATACTACGCA GACTCAGTGAAGGGCC GATTCACCTTCTCCAGA GACAACGCCAAGAACT CACTGGATCTGCAAATG AGCGGCCTGAGAGCCG AGGACACGGCTATTTAT TACTGTACGAGAGGCTG GGGGCCTTTTGACTACT GGGGCCAGGGAACCCT GGTCACCGTCTCCTCA | 113 | GACATCCAAATGACTCAA TCACCTAGCAGCCTCTCCG CCTCCGTTGGAGATAGAG TGACAATAACTTGCCGAG CCCGGCAAAGTATCGGAA CTGCTATTCACTGGTATCA ACAAAAACCTGGAAAGGC ACCTAAGCTCTTGATTAAA TACGCTTCTGAGTCCATCT CCGGCGTGCCTTCACGATT CAGCGGCAGCGGTAGTGG TACTGACTTTACCCTCACT ATTAGTTCTGTTCAGCCAG AGGACTTCGCAACTTATTA CTGCCAACAGAGTGGTTC CTGGCCATACACTTTTGGC CAGGGGACTAAATTGGAA ATCAAA | 116 |
| CD3W247 | GAGGTGCAACTGGTGG AGTCTGGGGGAGGCCT GGTCAAGCCTGGGGGG TCCCTGAGACTCTCCTG TGCAGCCTCTGGATTCA CCTTCAGTAGATATAAC ATGAACTGGGTCCGCCA GGCTCCAGGGAAGGGG CTGGAGTGGGTCTCATC CATTAGTACTAGTAGTA ATTACATATACTACGCA GACTCAGTGAAGGGCC GATTCACCTTCTCCAGA GACAACGCCAAGAACT | 113 | GACATCCAAATGACTCAA AGCCCCTCTAGTTTGAGTG CATCTGTAGGTGACCGGG TAACAATCACCTGCCGTGC CCGGCAAAGTATAGGTAC TGCAATCCACTGGTACCA GCAAAAACCCGGCAAAGC ACCAAAGCTGCTCATATA CTATGCTAGTGAGAGCATT TCTGGCGTTCCTAGTCGAT TTTCTGGATCAGGGAGTG GAACTGATTTTACACTGAC AATCAGCAGCCTCCAACC CGAAGACTTCGCCACCTA | 117 |

TABLE 8-continued

VH and VL nucleic acid sequences of the humanized scFv variants.

| Binding domain name | VH nucleic acid Sequence | VH SEQ ID NO: | VL nucleic acid sequence | VL SEQ ID NO: |
|---|---|---|---|---|
| | CACTGGATCTGCAAATG AGCGGCCTGAGAGCCG AGGACACGGCTATTTAT TACTGTACGAGAGGCTG GGGGCCTTTTGACTACT GGGGCCAGGGAACCCT GGTCACCGTCTCCTCA | | CTATTGTCAGCAGTCTGGG TCCTGGCCTTACACATTCG GTCAAGGAACTAAATTGG AGATCAAA | |
| CD3W248 | GAGGTGCAACTGGTGG AGTCTGGGGGAGGCCT GGTCAAGCCTGGGGGG TCCCTGAGACTCTCCTG TGCAGCCTCTGGATTCA CCTTCAGTAGATATAAC ATGAACTGGGTCCGCCA GGCTCCAGGGAAGGGG CTGGAGTGGGTCTCATC CATTAGTACTAGTAGTA ATTACATATACTACGCA GACTCAGTGAAGGGCC GATTCACCTTCTCCAGA GACAACGCCAAGAACT CACTGGATCTGCAAATG AGCGGCCTGAGAGCCG AGGACACGGCTATTTAT TACTGTACGAGAGGCTG GGGGCCTTTTGACTACT GGGGCCAGGGAACCCT GGTCACCGTCTCCTCA | 113 | GACATTTTGCTGACACAG AGCCCTGGTATCCTCTCAG TCAGTCCAGGGGAACGCG TTTCATTTAGCTGCCGTGC TCGACAGAGCATTGGGAC CGCAATCCACTGGTACCA ACAAAGAACTAACGGTTC ACCACGGCTTTTGATTAAG TATGCCTCCGAATCCATCA GTGGCATTCCTAGTCGTTT TTCTGGATCAGGATCAGG CACCGACTTTACTCTCACA ATTAATAGTGTCGAAAGT GAGGACATTGCAGACTAT TATTGTCAGCAATCCGGTT CCTGGCCCTATACTTTTGG TGGTGGTACTAAGTTGGA AATTAAA | 118 |

TABLE 9

CDR sequences determined using Kabat deliniation.

| | HCDR1 (SEQ ID NO:) | HCDR2 (SEQ ID NO:) | HCDR3 (SEQ ID NO:) | LCDR1 (SEQ ID NO:) | LCDR2 (SEQ ID NO:) | LCDR3 (SEQ ID NO:) |
|---|---|---|---|---|---|---|
| CD3 B815 | RYNMN (6) | SISTSSNYIY YADSVKG (7) | GWGPFDY (8) | RARQSIGTAIH (9) | YASESIS (10) | QQSNSWPYT (121) |
| CD3 W244 | RYNMN (6) | SISTSSNYIY YADSVKG (7) | GWGPFDY (8) | RARQSIGTAIH (9) | YASESIS (10) | QQSGSWPY T (11) |
| CD3 W245 | RYNMN (6) | SISTSSNYIY YADSVKG (7) | GWGPFDY (8) | RARQSIGTAIH (9) | YASESIS (10) | QQSGSWPY T (11) |
| CD3 W246 | RYNMN (6) | SISTSSNYIY YADSVKG (7) | GWGPFDY (8) | RARQSIGTAIH (9) | YASESIS (10) | QQSGSWPY T (11) |
| CD3 W247 | RYNMN (6) | SISTSSNYIY YADSVKG (7) | GWGPFDY (8) | RARQSIGTAIH (9) | YASESIS (10) | QQSGSWPY T (11) |
| CD3 W248 | RYNMN (6) | SISTSSNYIY YADSVKG (7) | GWGPFDY (8) | RARQSIGTAIH (9) | YASESIS (10) | QQSGSWPY T (11) |

TABLE 10

CDR sequences determined using Chothia deliniation.

| | HCDR1 (SEQ ID NO:) | HCDR2 (SEQ ID NO:) | HCDR3 (SEQ ID NO:) | LCDR1 (SEQ ID NO:) | LCDR2 (SEQ ID NO:) | LCDR3 (SEQ ID NO:) |
|---|---|---|---|---|---|---|
| CD3B815 | GFTFSRY (12) | STSSNY (13) | GWGPFD (14) | RQSIGTA (15) | YAS (16) | SNSWPY (122) |
| CD3W244 | GFTFSRY (12) | STSSNY (13) | GWGPFD (14) | RQSIGTA (15) | YAS (16) | SGSWPY (17) |
| CD3W245 | GFTFSRY (12) | STSSNY (13) | GWGPFD (14) | RQSIGTA (15) | YAS (16) | SGSWPY (17) |
| CD3W246 | GFTFSRY (12) | STSSNY (13) | GWGPFD (14) | RQSIGTA (15) | YAS (16) | SGSWPY (17) |
| CD3W247 | GFTFSRY (12) | STSSNY (13) | GWGPFD (14) | RQSIGTA (15) | YAS (16) | SGSWPY (17) |
| CD3W248 | GFTFSRY (12) | STSSNY (13) | GWGPFD (14) | RQSIGTA (15) | YAS (16) | SGSWPY (17) |

TABLE 11

CDR sequences determined using IMGT deliniation.

| | HCDR1 (SEQ ID NO:) | HCDR2 (SEQ ID NO:) | HCDR3 (SEQ ID NO:) | LCDR1 (SEQ ID NO:) | LCDR2 (SEQ ID | LCDR3 (SEQ ID NO:) |
|---|---|---|---|---|---|---|
| CD3B815 | GFTFSRYN (18) | ISTSSNYI (19) | TRGWGPFDY (20) | QSIGTA (21) | YAS (16) | QQSNSWPYT (123) |
| CD3W244 | GFTFSRYN (18) | ISTSSNYI (19) | TRGWGPFDY (20) | QSIGTA (21) | YAS (16) | QQSGSWPYT (22) |
| CD3W245 | GFTFSRYN (18) | ISTSSNYI (19) | TRGWGPFDY (20) | QSIGTA (21) | YAS (16) | QQSGSWPYT (22) |
| CD3W246 | GFTFSRYN (18) | ISTSSNYI (19) | TRGWGPFDY (20) | QSIGTA (21) | YAS (16) | QQSGSWPYT (22) |
| CD3W247 | GFTFSRYN (18) | ISTSSNYI (19) | TRGWGPFDY (20) | QSIGTA (21) | YAS (16) | QQSGSWPYT (22) |
| CD3W248 | GFTFSRYN (18) | ISTSSNYI (19) | TRGWGPFDY (20) | QSIGTA (21) | YAS (16) | QQSGSWPYT (22) |

FIG. 3 shows the alignment of the VL regions of CD3B3815, CD3W244, CD3W245, CD3W246, and CD3W247. A consensus amino acid sequence of SEQ ID NO: 103 was determined for the VL region, and CDR residues are underlined.

SEQ ID NO: 103

DIQ$X_1$TQSP$X_2X_3$LS$X_4$S$X_5$G$X_6$RV$X_7X_8X_9$CRARQSIGTAIHWYQQK $X_{10}X_{11}X_{12}X_{13}$P$X_{14}$LLI$X_{15}$YASESISG$X_{16}$PSRFSGSGSGTDFTL

TI$X_{17}$S$X_{18}$Q$X_{19}$ED$X_{20}$A$X_{21}$YYCQQS$X_{22}$SWPYTFG$X_{23}$GTKLEIK wherein, $X_1$ is L or M; $X_2$ is G or S; $X_3$ is I or S; $X_4$ is V or A; $X_5$ is P or V; $X_6$ is E or D; $X_7$ is S or T; $X_8$ is F on; $X_9$ is S or T; $X_{10}$ is T or P, $X_{11}$ is N or G, $X_{12}$ is G or K, $X_{13}$ is S or A; $X_{14}$ is R or K, $X_{15}$ is K or Y; $X_{16}$ is I or V; $X_{17}$ is N or S; $X_{18}$ is V or L; $X_{19}$ is S or P, $X_{20}$ is I or F; $X_{21}$ is D or T, $X_{22}$ is N or G; or $X_{23}$ is G or Q.

Binding of Humanized Anti-CD3 scFv Variants to CD3 after Heat Shock.

The variable region from CD3B3815 was next formatted as scFv in VH-VL orientation using linker GTEGKSSGSGSESKST (SEQ ID No: 64) (Table 12) for expression in *E. coli*, and then screened for binding to recombinant CD3 (CD3W147, SEQ ID NO: 4), binding to T cells, and thermostability.

TABLE 12

| scFv-HL-E.c. amino acid sequences. | |
|---|---|
| scFv | Amino acid sequence |
| CD3W234-HL-E.c.<br>(SEQ ID NO: 104) | EVQLVESGGGLVKPGGSLRLSCAASGFTFSRYNMNWVRQAPGKGLEW<br>VSSISTSSNYIYYADSVKGRFTFSRDNAKNSLDLQMSGLRAEDTAIYYC<br>TRGWGPFDYWGQGTLVTVSSGTEGKSSGSGSESKSTDILLTQSPGILSVS<br>PGERVSFSCRARQSIGTAIHWYQQRTNGSPRLLIKYASESISGIPSRFSGS<br>GSGTDFTLTINSVESEDIADYYCQQSNSWPYTFGGGTKLEIKGPGGQHH<br>HHHHGAYPYDVPDYAS |
| CD3W238-HL-E.c.<br>(SEQ ID NO: 105) | EVQLVESGGGLVKPGGSLRLSCAASGFTFSRYNMNWVRQAPGKGLEW<br>VSSISTSSNYIYYADSVKGRFTFSRDNAKNSLDLQMSGLRAEDTAIYYC<br>TRGWGPFDYWGQGTLVTVSSGTEGKSSGSGSESKSTDIQMTQSPSSLSA<br>SVGDRVTITCRARQSIGTAIHWYQQKPGKAPKLLIYYASESISGVPSRFS<br>GSGSGTDFTLTISSLQPEDFATYYCQQSNSWPYTFGQGTKLEIKGPGGQ<br>HHHHHHGAYPYDVPDYAS |
| CD3W242-HL-E.c.<br>(SEQ ID NO: 106) | EVQLVESGGGLVKPGGSLRLSCAASGFTFSRYNMNWVRQAPGKGLEW<br>VSSISTSSNYIYYADSVKGRFTFSRDNAKNSLDLQMSGLRAEDTAIYYC<br>TRGWGPFDYWGQGTLVTVSSGTEGKSSGSGSESKSTDIQMTQSPSSLSA<br>SVGDRVTITCRARQSIGTAIHWYQQKPGKAPKLLIKYASESISGVPSRFS<br>GSGSGTDFTLTISSLQPEDFATYYCQQSNSWPYTFGQGTKLEIKGPGGQ<br>HHHHHHGAYPYDVPDYAS |
| CD3W243-HL-E.c.<br>(SEQ ID NO:107) | EVQLVESGGGLVKPGGSLRLSCAASGFTFSRYNMNWVRQAPGKGLEW<br>VSSISTSSNYIYYADSVKGRFTFSRDNAKNSLDLQMSGLRAEDTAIYYC<br>TRGWGPFDYWGQGTLVTVSSGTEGKSSGSGSESKSTDIQMTQSPSSLSA<br>SVGDRVTITCRARQSIGTAIHWYQQKPGKAPKLLIKYASESISGVPSRFS<br>GSGSGTDFTLTISSVQPEDFATYYCQQSNSWPYTFGQGTKLEIKGPGGQ<br>HHHHHHGAYPYDVPDYAS |
| CD3W244-HL-E.c.<br>(SEQ ID NO: 108) | EVQLVESGGGLVKPGGSLRLSCAASGFTFSRYNMNWVRQAPGKGLEW<br>VSSISTSSNYIYYADSVKGRFTFSRDNAKNSLDLQMSGLRAEDTAIYYC<br>TRGWGPFDYWGQGTLVTVSSGTEGKSSGSGSESKSTDIQMTQSPSSLSA<br>SVGDRVTITCRARQSIGTAIHWYQQKPGKAPKWYYASESISGVPSRFS<br>GSGSGTDFTLTISSVQPEDFATYYCQQSGSWPYTFGQGTKLEIKGPGGQ<br>HHHHHHGAYPYDVPDYAS |
| CD3W245-HL-E.c.<br>(SEQ ID NO: 109) | EVQLVESGGGLVKPGGSLRLSCAASGFTFSRYNMNWVRQAPGKGLEW<br>VSSISTSSNYIYYADSVKGRFTFSRDNAKNSLDLQMSGLRAEDTAIYYC<br>TRGWGPFDYWGQGTLVTVSSGTEGKSSGSGSESKSTDIQMTQSPSSLSA<br>SVGDRVTITCRARQSIGTAIHWYQQKPGKAPKLLIKYASESISGVPSRFS<br>GSGSGTDFTLTISSLQPEDFATYYCQQSGSWPYTFGQGTKLEIKGPGGQ<br>HHHHHHGAYPYDVPDYAS |
| CD3W246-HL-E.c.<br>(SEQ ID NO: 110) | EVQLVESGGGLVKPGGSLRLSCAASGFTFSRYNMNWVRQAPGKGLEW<br>VSSISTSSNYIYYADSVKGRFTFSRDNAKNSLDLQMSGLRAEDTAIYYC<br>TRGWGPFDYWGQGTLVTVSSGTEGKSSGSGSESKSTDIQMTQSPSSLSA<br>SVGDRVTITCRARQSIGTAIHWYQQKPGKAPKLLIKYASESISGVPSRFS<br>GSGSGTDFTLTISSVQPEDFATYYCQQSGSWPYTFGQGTKLEIKGPGGQ<br>HHHHHHGAYPYDVPDYAS |
| CD3W247-HL-E.c.<br>(SEQ ID NO: 111) | EVQLVESGGGLVKPGGSLRLSCAASGFTFSRYNMNWVRQAPGKGLEW<br>VSSISTSSNYIYYADSVKGRFTFSRDNAKNSLDLQMSGLRAEDTAIYYC<br>TRGWGPFDYWGQGTLVTVSSGTEGKSSGSGSESKSTDIQMTQSPSSLSA<br>SVGDRVTITCRARQSIGTAIHWYQQKPGKAPKWYYASESISGVPSRFS<br>GSGSGTDFTLTISSLQPEDFATYYCQQSGSWPYTFGQGTKLEIKGPGGQ<br>HHHHHHGAYPYDVPDYAS |
| CD3W248-HL-E.c.<br>(SEQ ID NO: 112) | EVQLVESGGGLVKPGGSLRLSCAASGFTFSRYNMNWVRQAPGKGLEW<br>VSSISTSSNYIYYADSVKGRFTFSRDNAKNSLDLQMSGLRAEDTAIYYC<br>TRGWGPFDYWGQGTLVTVSSGTEGKSSGSGSESKSTDILLTQSPGILSVS<br>PGERVSFSCRARQSIGTAIHWYQQRTNGSPRLLIKYASESISGIPSRFSGS<br>GSGTDFTLTINSVESEDIADYYCQQSGSWPYTFGGGTKLEIKGPGGQHH<br>HHHHGAYPYDVPDYAS |
| CD3W147 (SEQ ID NO: 4):<br>QDGNEEMGGITQTPYKVSISGTTVILTCPQYPGSEILWQHNDKNIGGDEDDKNIGSDEDH<br>LSLKEFSELEQSGYYVCYPRGSKPEDANFYLYLRARVGSADDAKKDAAKKDDAKKDDAKKDG<br>SQSIKGNHLVKVYDYQEDGSVLLTCDAEAKNITWFKDGKMIGFLTEDKKKWNLGSNAKDPRG<br>MYQCKGSQNKSKPLQVYYRMGSGSLGGPSVFLFPPKPKDTLMISRTPEVTCVVVDVSQEDPEVQ<br>FNWYVDGVEVHNAKTKPREEQFNSTYRVVSVLTVLHQDWLNGKEYKCKVSNKGLPSSIEKTIS<br>KAKGQPREPQVYTFPPSQEEMTKNQVSLRCLVKGFYPSDIAVEWESNGQPENNYKTTKPVLDSD<br>GSFRLESRLTVDKSRWQEGNVFSCSVMHEALHNHYTQKSLSLSGGHHHHHH | |

The binding of anti-CD3 scFv variants (Table 7), expressed in *E. coli*, to CD3 was determined. Briefly, scFv-coding sequences were cloned into a pADL™-22c vector having a PelB leader sequence for secretion (Antibody Design Labs, San Diego, Calif.). *E. coli* cells were transformed with plasmid and grown overnight at 37° C. in 2×YT microbial growth medium supplemented with 100 μg/mL Carbenicillin. Overnight cultures were used to inoculate 5 mL expression cultures and grown at 37° C. until $OD_{600}$~2.0. Protein expression was induced by addition of 1 mM IPTG and cultures were grown overnight. After expression, cells were pelleted by centrifugation at 2,200×g for 5 min and supernatants were collected and tested directly in ELISA analysis.

Figure 2:
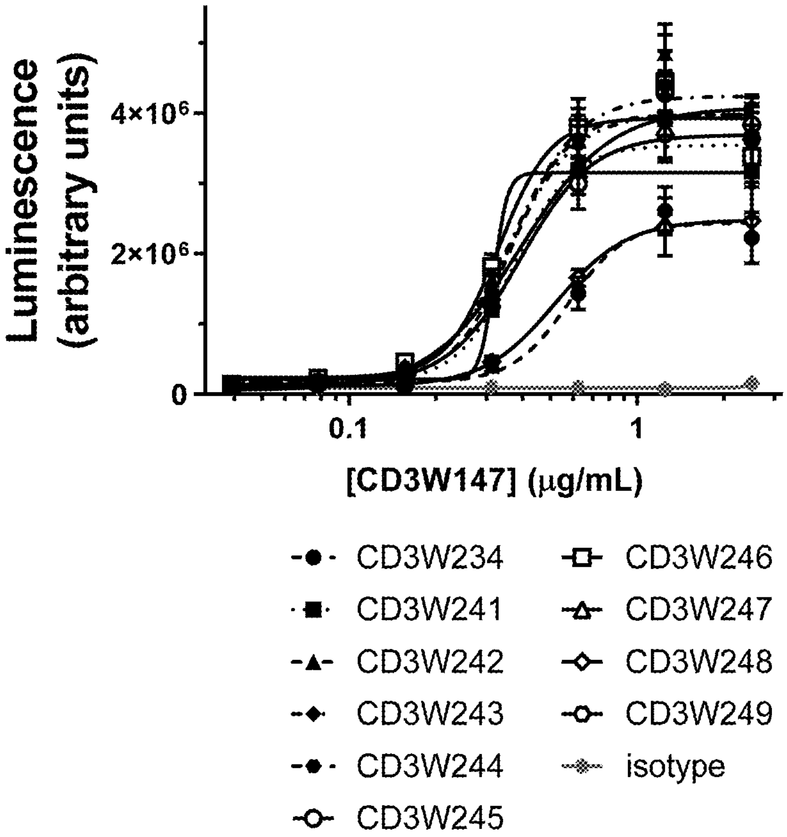
FIG. 2 shows binding of anti-CD3 scFv variants, expressed in *E. coli*, to CD3.

For ELISA analysis, biotinylated CD3W147 (homodimeric CD3εγ-Fc, SEQ ID NO: 4) was immobilized on the plate in concentrations raging from 0.039 ug/mL to 2.5 ug/mL in 2-fold dilutions followed by incubation at room temperature for 45 min. Plates were blocked with 1×PBS-Tween® supplemented with 3% milk. Plates were washed with 1×PBS-Tween®. *E. coli* supernatants were heated to 60° C. then cooled to room temperature to assess their thermal stability. Supernatant was added to each plate and incubated for 45 min at room temperature. Bound scFv was detected using chicken anti-HA horseradish peroxidase diluted 1:1,000 at 50 uL per well and then detected with chemiluminescence substrate (Sigma cat. #1158950001). All tested scFv molecules derived from CD3B815 bound CD3ε (FIG. 2).

The scFv molecules were then tested for their abilities to bind T cells, using flow cytometry. Briefly, human T cells were thawed and resuspended into flow staining buffer at 1x10^6 cells/mL and plated at 50,000 cells/well. A positive control, CD3W36 was comprised of an anti-CD3 antibody SP34 formatted as LH-scFv, and a negative control, B23, an scFv targeted against the F-glycoprotein from respiratory syncytial virus, were used for comparison of binding. *E. coli* supernatants were added at 150 uL/well and incubated at 4° C. for 1 hr. After incubation, plates were washed with staining buffer and detected with anti-His antibody conjugated to Alexa Fluor® 647 diluted 1:100 in staining buffer with incubation for 30 min at 4° C. After incubation, 200 μL of IntelliCyt running buffer was added to the mixture, and cells were resuspended in 30 uL running buffer containing 1:1,000 Sytox® Green dead cell stain and analyzed on iQue® Screener. Gating and analysis was performed as above. All scFv molecules derived from CD3B815 displayed mean fluorescence indices consistent with T cell binding (Table 13).

TABLE 13

T cell-based binding of humanized scFv molecules.

| Protein | MFI (n = 2) |
|---|---|
| CD3W245-HL-E.C. | 178140.0 |
| CD3W244-HL-E.C. | 165631.0 |
| CD3W246-HL-E.C. | 153895.8 |
| CD3W238-HL-E.C. | 137380.4 |
| CD3W242-HL-E.C. | 126105.9 |
| CD3W243-HL-E.C. | 111347.6 |
| CD3W241-HL-E.C. | 120793.8 |
| CD3W247-HL-E.C. | 110932.3 |
| CD3W248-HL-E.C. | 60437.1 |
| CD3W234-HL-E.C. | 66790.3 |
| B23 | 51.8 |
| CD3W36 | 99451.6 |

Epitope Identification

The epitope on CD3 was determined by hydrogen-deuterium exchange mass spectrometry (HDX-MS). The antibody clone OKT3 was used as a control for the HDX experiment, since its epitope on CD3ε was known from crystal structure (PDB ID 1SY6) (Kjer-Nielsen, L. et al.; *Proc Natl Acad Sci US A* 101, 7675-7680).

On-Exchange Experiment for HDX-MS. On-exchange reaction was initiated by mixing 10 μL of 10 μM CD3W220 (SEQ ID NO: 5), which was comprised of CD3εγ fused with a 26-aa linker region fused onto a serum albumin domain, with or without 1.2 molar-excess of ligand and 30 μL of H2O or a deuterated buffer (20 mM MES, pH 6.4, 150 mM NaCl in 95% D20 or 20 mM Tris, pH 8.4, 150 mM NaCl in 95% D20). The reaction mixture was incubated for 15, 50, 150, 500, or 1,500 s at 1.2° C. The on-exchanged solution was quenched by the addition of chilled 40 μL of 8 M urea, 1 M TCEP, pH 3.0 and immediately analyzed.

```
CD3W220 (CD3εγ-HSA-6xHis) (SEQ ID NO: 5):
QDGNEEMGGITQTPYKVSISGTTVILTCPQYPGSEILWQHNDKNIGGDED

DKNIGSDEDHLSLKEFSELEQSGYYVCYPRGSKPEDANFYLYLRARVGSA

DDAKKDAAKKDDAKKDDAKKDGSQSIKGNHLVKVYDYQEDGSVLLTCDAE

AKNITWFKDGKMIGFLTEDKKKWNLGSNAKDPRGMYQCKGSQNKSKPLQV

YYRNIGGGSDAHKSEVAHRFKDLGEENFKALVLIAFAQYLQQSPFEDHVK

LVNEVTEFAKTCVADESAENCDKSLHTLFGDKLCTVATLRETYGEMADCC

AKQEPERNECFLQHKDDNPNLPRLVRPEVDVMCTAFHDNEETFLKKYLYE

IARRHPYFYAPELLFFAKRYKAAFTECCQAADKAACLLPKLDELRDEGKA

SSAKQRLKCASLQKFGERAFKAWAVARLSQRFPKAEFAEVSKLVTDLTKV

HTECCHGDLLECADDRADLAKYICENQDSISSKLKECCEKPLLEKSHCIA

EVENDEMPADLPSLAADFVESKDVCKNYAEAKDVFLGMFLYEYARRHPDY

SVVLLLRLAKTYETTLEKCCAAADPHECYAKVFDEFKPLVEEPQNLIKQN

CELFEQLGEYKFQNALLVRYTKKVPQVSTPTLVEVSRNLGKVGSKCCKHP

EAKRMPCAEDYLSVVLNQLCVLHEKTPVSDRVTKCCTESLVNRRPCFSAL

EVDETYVPKEFNAETFTFHADICTLSEKERQIKKQTALVELVKHKPKATK

EQLKAVMDDFAAFVEKCCKADDKETCFAEEGKKLVAASQAALGLGGGSHH

HHHHHH
```

General Procedure for HDX-MS Data Acquisition. HDX-MS sample preparation was performed with automated HDx system (LEAP Technologies, Morrisville, NC). The columns and pump were; protease, protease type XIII (protease from *Aspergillus saitoi*, type XIII)/pepsin column (w/w, 1:1; 2.1×30 mm) (NovaBioAssays Inc., Woburn, MA); trap, ACQUITY UPLC BEH C18 VanGuard Pre-column (2.1×5 mm) (Waters, Milford, MA), analytical, Accucore C18 (2.1×100 mm) (Thermo Fisher Scientific, Waltham, MA); and LC pump, VH-P10-A (Thermo Fisher Scientific). The loading pump (from the protease column to the trap column) was set at 600 μL/min with 99% water, 1% acetonitrile, 0.10% formic acid. The gradient pump (from the trap column to the analytical column) was set from 8% to 28% acetonitrile in 0.1% aqueous formic acid in 20 min at 100 μL/min.

MS Data Acquisition. Mass spectrometric analyses were carried out using an LTQ™ Orbitrap Fusion Lumos mass spectrometer (Thermo Fisher Scientific) with the capillary temperature at 275° C., resolution 150,000, and mass range (m/z) 300-1,800.

HDX-MS Data Extraction. BioPharma Finder 3.0 (Thermo Fisher Scientific) was used for the peptide identification of non-deuterated samples prior to the HDX experiments. HDExaminer version 2.5 (Sierra Analytics, Modesto, CA) was used to extract centroid values from the MS raw data files for the HDX experiments.

HDX-MS Data Analysis. The extracted HDX-MS data were further analyzed in Excel. All exchange time points (at pH 6.4 or pH 8.4 at 1.2° C.) were converted to the equivalent time points at pH 7.4 and 23° C. (e.g., 15 s at pH 6.4 at 1.2° C. is equivalent of 0.15 s at pH 7.4 at 23° C.; Table 14).

TABLE 14

HDX reaction conditions and exchange times versus exchange times corrected to pH 7.4 and 23° C.

| Time adjusted to pH 7.4, 23° C. (s) | pH 6.4 1.2° C. (s) | pH 8.4 1.2° C. (s) |
|---|---|---|
| 0.015 | — | — |
| 0.05 | — | — |
| 0.15 | 15 | — |
| 0.5 | 50 | — |
| 1.5 | 150 | — |
| 5 | 500 | — |
| 15 | 1,500 | 15 |
| 50 | — | 50 |
| 150 | — | 150 |
| 500 | — | 500 |
| 1,500 | — | 1,500 |

Results. Incubation of the KLCB91, the bispecific antibodies comprising CD3W245 as an anti-CD3 arm (described in the Example 3), with recombinant CD3ε (SEQ ID NO: 5) resulted in different patterns of overall protection and degrees of protection at specific segments of the antigen. KLCB91 and OKT3 both protected non-continuous segments (FIG. 4) indicating conformational non-identical epitopes. The protected segments were mapped onto the crystal structure of CD3ε (PDB 1SY6) to visualize the binding epitopes in three dimensions.

Consistent with the crystal structure of OKT3 bound to CD3ε (Uniprot ID P07766), the epitope of OKT3 was found to consist of peptides covering spanning residues 29-37, 79-84, and 87-89 of CD3F (SEQ ID NO: 5 and FIG. 4). CD3W245 bound to an epitope partially overlapping with that of OKT3, and included amino acid residues 29-37 (PQYPGSEIL, SEQ ID NO: 100), 55-63 (GSDEDHLSL, SEQ ID NO: 101), and 79-84 (PRGSKP, SEQ ID NO: 102) of CD3F (SEQ ID NO: 5 and FIG. 4).

Example 2. Generation of Anti-Kallikrein Related Peptidase 2 (hK2) Antibodies and scFvs Antibody Generation from Humanization of Parental m11B6 Antibody.

A parental mouse anti-kallikrein related peptidase 2 (hK2) antibody, m11B6, has been described in Väisänen et al (Clinical Chemistry 50:9, 1607-1617 (2004)). Humanized 11B6 (referred herein to as hu11B6) has been generated and described in U.S. Pat. Nos. 9,345,782 and 10,100,125.

Engineering of hu11B6 were initiated to generate additional anti-HK2 antibodies with improved properties, such as improved thermostability. Residue positions were identified in hu11B6 frameworks which could potentially be altered to improve thermostability of hu11B6 using modeling. The positions identified were residues P41, 149, M70, and A88 in the VH and S80, L82, A88 and Y91 in the VL (residue numbering according to the amino acid sequences of hu11B6_VH of SEQ ID NO: 124 and hu11B6_VL of SEQ ID NO: 125).

Binary combinatorial scFv libraries were generated in the orientation VH-linker-VL in which one of the variable regions represented the combinatorial library and the second one being the parental hu11B6 VH or VL. Linker sequence of GGSEGKSSGSGSESKSTGGS (SEQ ID NO: 31) was used to conjugate the VH/VL regions. The engineered scFvs were expressed in *E. coli* and the produced scFvs in the supernatants were tested for binding to human hK2 by ELISA and compared to the binding of hu11B6. Any new variants exhibiting binding comparable to hu11B6 were consolidated and further tested for binding to human hK2 after incubation of the supernatants at 55° C., 60° C., and 65° C. for 10 minutes. The molecules which retained comparable binding to hu11B6 after incubation at 55° C., 60° C., and 65° C. and improved thermostability were matrixed in both orientations (VH-linker-VL; VL-linker-VH) and converted to mammalian scFvs for further characterization.

In addition, another humanization of parental mouse 11B6 was performed following the approach outlined by Singh et al (MAbs. 2015; 7(4):778-91). with extensive germ line variation and careful screening of the variants for enhanced thermal stability. Based on sequence conservation, the human heavy chain germline IGHV4-30 and the light chain germline IGKV3D-11, were chosen for framework adaption. A binary scFv library was constructed with residues comprising a select set of somatic hypermutation sites and mouse/human germline variations. The variants were cloned and expressed in *E. coli* as described above. The supernatants were screened at different temperatures in single point ELISA for enhanced thermal stability. A mouse/human chimeric 11B6 scFv was used as parental control. Clone KL2B359 which maintained binding activity similar to murine 11B6 and a Tm value of 67° C. was converted to scFv-Fc for additional profiling. Measured affinity ($K_D$) of KL2B359 to hK2 by SPR was ~0.7-1 nM. HCF3-LCD6, HCG5-LCB7, KL2B357, KL2B358 and KL2B360 also resulted from this campaign and were further characterized for functionality.

Antibody Generation Using Transgenic Mice (Ablexis®) and Transgenic Rats (OmniRat®) Expressing Human Immunoglobulin Loci.

The OmniRat® contains a chimeric human/rat IgH locus (comprising 22 human $V_H$s, all human D and JH segments in natural configuration linked to the rat $C_H$ locus) together with fully human IgL loci (12 Vκs linked to Jκ-Cκ and 16 VWs linked to JR-C). (see e.g., Osborn, et al. (2013) J Immunol 190(4): 1481-1490). Accordingly, the rats exhibit reduced expression of rat immunoglobulin, and in response to immunization, the introduced human heavy and light chain transgenes undergo class switching and somatic mutation to generate high affinity chimeric human/rat IgG monoclonal antibodies with fully human variable regions. The preparation and use of OmniRat®, and the genomic modifications carried by such rats, is described in WO14/093908.

Ablexis® mice (described in Example 1) and OmniRat® rats were immunized with soluble full length KLK2 protein (human Kallikrein-2 6-His protein).

```
human Kallikrein-2 6-His protein (SEQ ID NO: 355):
VPLIEGRIVGGWECEKHSQPWQVAVYSHGWAHCGGVLVHPQWVLTAAHCL

KKNSQVWLGRHNLFEPEDTGQRVPVSHSFPHPLYNMSLLKHQSLRPDEDS

SHDLMLLRLSEPAKITDVVKVLGLPTQEPALGTTCYASGWGSTEPEEFLR

PRSLQCVSLHYSEKVTEFMLCAGLWTGGKDTCGGDSGGPLVCNGVLQGIT

SWGPEPCALPEKPAVYTKVVHYRKWIKDTIIAANPHHHHHH
```

Lymphocytes from Ablexis® mice and OmniRats® rats were extracted from lymph nodes and fusions performed by cohorts. Cells were combined and sorted for CD138 expression. Hybridoma screening was performed in high throughput miniaturized MSD format using soluble hK2 antigen. Approximately >300 samples were identified to be hK2 binders. The binding of >300 anti-hKLK2 supernatant samples to human KLK2 protein was measured by single cycle kinetics method by Biacore® 8K SPR. Additionally, the supernatant samples were tested for binding to human KLK3 protein as well. In parallel, supernatants were also tested for binding to KLK2 expressing cell line VCap and negative cell line DU145 by Flow Cytometry. Selected cell binders were moved to scFv conversion in both VH-VL and VL/VH orientation and thermal stability tests as described above. KL2B413, KL2B30, KL2B53 and KL2B242 resulted from the Ablexis® mice immunization campaign. KL2B467 and KL2B494 resulted from the OmniRat® immunization campaign.

Antibodies generated through the various immunization and humanization campaigns described above were expressed in a Fab format, a mAb format, a scFv format in the VH-linker-VL orientation or a scFv format in VL-linker-VH orientation and were further analyzed as described below. The linker sequence of SEQ ID NO: 31 described above was used to conjugate the VH/VL regions.

Structural Characterization of Anti KLK2 Antibodies

Sequences of antibody variable domains and scFv antibody fragments which showed highest performance in intracellular assay are provided herein. Variable domains were expressed in a Fab format, a scFv format in the VH-linker-VL orientation or a scFv format in VL-linker-VH orientation.

Variable Domains VH, VL and CDRs

Table 15 shows the VH and VL amino acid sequences of selected anti-hK2 antibodies. Table 16 shows the Kabat HCDR1, HCDR2 and HCDR3 of selected anti-hK2 selected antibodies. Table 17 shows the Kabat LCDR1, LCDR2 and LCDR3 of the selected anti-hK2 antibodies. Table 18 shows the AbM HCDR1, HCDR2 and HCDR3 of selected anti-hK2 antibodies. Table 19 shows the AbM LCDR1, LCDR2 and LCDR3 of the anti-hK2. Table 20 summarizes the variable domain sequence and SEQ ID NOs of selected hK2 antibodies. Table 21 shows the protein and DNA SEQ ID NOs for the VH and VL regions.

TABLE 15

VH and VL amino acid sequences of selected anti-hK2 antibodies.

| mAb name | VH name | VH amino acid Sequence | VH SEQ ID NO: | VL name | VL amino acid sequence | VL SEQ ID NO: |
|---|---|---|---|---|---|---|
| m11B6 | m11B6_VH | DVQLQESGPGLVKPS QSLSLTCTVTGNSITS DYAWNWIRQFPGNR LEWMGYISYSGSTTY SPSLKSRFSITRDTSKN QFFLQLNSVTPEDTA TYFCATGYYYGSGFW GQGTLVTVSS | 126 | m11B6_VL | DIVLTQSPASLAVSLGQ RATISCRASESVEYFGTS LMHWYRQKPGQPPKLL IYAASNVESGVPARFSG SGSGTDFSLNIQPVEED DFSMYFCQQTRKVPYT FGGGTKLEIK | 127 |
| h11B6 | hu11B6_VH | QVQLQESGPGLVKPS DTLSLTCAVSGNSITS DYAWNWIRQPPGKG LEWIGYISYSGSTTYN PSLKSRVTMSRDTSK NQFSLKLSSVTAVDTA VYYCATGYYYGSGFW GQGTLVTVSS | 124 | hu11B6_VL | DIVLTQSPDSLAVSLGER ATINCKASESVEYFGTSL MHWYQQKPGQPPKLLI YAASNRESGVPDRFSGS GSGTDFTLTISSLQAEDV AVYYCQQTRKVPYTFG QGTKLEIK | 125 |
| HCF3-LCD6 | HCF3_VH | QVQLQESGPGLVKPS DTLSLTCAVSGNSITS DYAWNWIRQFPGKG LEWIGYISYSGSTTYN PSLKSRVTISRDTSKN QFSLKLSSVTPVDTAV YYCATGYYYGSGFWG QGTLVTVSS | 128 | LCD6_VL | DIVLTQSPDSLAVSLGER ATINCKASESVEYFGTSL MHWYQQKPGQPPKLLI YAASNRESGVPDRFSGS GSGTDFTLTIQSVQAED VSVYFCQQTRKVPYTFG QGTKLEIK | 129 |
| HCG5-LCB7 | HCG5_VH | QVQLQESGPGLVKPS DTLSLTCAVSGNSITS DYAWNWIRQFPGKG LEWMGYISYSGSTTY NPSLKSRVTISRDTSK NQFSLKLSSVTPVDTA VYYCATGYYYGSGFW GQGTLVTVSS | 130 | LCB7_VL | DIVLTQSPDSLAVSLGER ATINCKASESVEYFGTSL MHWYQQKPGQPPKLLI YAASNRESGVPDRFSGS GSGTDFTLTISSVQAED VAVYYCQQTRKVPYTF GQGTKLEIK | 131 |
| KL2B357 | KL2B357_VH | QVQLQESGPGLVKPS QTLSLTCTVSGNSITS DYAWNWIRQFPGKG LEWIGYISYSGSTTYN PSLKSRVTISRDTSKN QFSLKLSSVTAADTAV YYCATGYYYGSGFWG QGTLVTVSS | 132 | KL2B357_VL | DIVLTQSPDSLAVSLGER ATINCRASESVEYFGTSL MHWYQQKPGQPPKLLI YAASNVESGVPDRFSGS GSGTDFTLTISSLQAEDV AVYFCQQTRKVPYTFG GGTKVEIK | 133 |

TABLE 15-continued

VH and VL amino acid sequences of selected anti-hK2 antibodies.

| mAb name | VH name | VH amino acid Sequence | VH SEQ ID NO: | VL name | VL amino acid sequence | VL SEQ ID NO: |
|---|---|---|---|---|---|---|
| KL2B358 | KL2B358_VH | QVQLQESGPGLVKPS QTLSLTCTVSGNSITS DYAWNWIRQPPGKG LEWIGYISYSGSTTYN PSLKSRVTISRDTSKN QFSLKLSSVTAADTAV YYCATGYYYGSGFWG QGTLVTVSS | 134 | KL2B358_VL | EIVLTQSPATLSLSPGER ATLSCRASESVEYFGTSL MHWYQQKPGQPPRLLI YAASNVESGIPARFSGS GSGTDFTLTISSVEPEDF AVYFCQQTRKVPYTFG GGTKVEIK | 135 |
| KL2B359 | KL2B359_VH | QVQLQESGPGLVKPS QTLSLTCTVSGNSITS DYAWNWIRQFPGKR LEWIGYISYSGSTTYN PSLKSRVTISRDTSKN QFSLKLSSVTAADTAV YYCATGYYYGSGFWG QGTLVTVSS | 136 | KL2B359_VL | EIVLTQSPATLSLSPGER ATLSCRASESVEYFGTSL MHWYQQKPGQPPRLLI YAASNVESGIPARFSGS GSGTDFTLTISSVEPEDF AVYFCQQTRKVPYTFG GGTKVEIK | 135 |
| KL2B360 | KL2B360_VH | QVQLQESGPGLVKPS QTLSLTCTVSGNSITS DYAWNWIRQFPGKG LEWIGYISYSGSTTYN PSLKSRVTISRDTSKN QFSLKLSSVTAADTAV YYCATGYYYGSGFWG QGTLVTVSS | 132 | KL2B360_VL | EIVLTQSPATLSLSPGER ATLSCRASESVEYFGTSL MHWYQQKPGQPPRLLI YAASNVESGIPARFSGS GSGTDFTLTISSVEPEDF AVYFCQQTRKVPYTFG GGTKVEIK | 135 |
| KL2B413 | KL2B413_VH | EVQLVESGGGLVQPG GSLRLSCAASGFTFSS YWMTWVRQAPGKG LEWVANIKQDGSERY YVDSVKGRFTISRDN AKNSLYLQMNSLRAE DTAVYYCARDQNYDI LTGHYGMDVWGQG TTVTVSS | 137 | KL2B413_VL | EIVLTQSPSFLSASVGDR VTITCRASQGISSYLSWY QQKPGKAPKLLIYATSTL QSGVPSRFSGSGSGTEF TLTISSLQPEDFATYYCQ QLNSYPRTFGQGTKVEI K | 138 |
| KL2B30 | KL2B30_VH | QVQLQESGPGLVKPS ETLSLTCTVSGGSISSY YWSWIRQPPGKGLE WIGYIYYSGSTNYNPS LKSRVTISVDTSKNQF SLKLSSVTAADTAVYY CAGTTIFGVVTPNFYY GMDVWGQGTTVTV SS | 139 | KL2B30_VL | DIQMTQSPSFLSASVGD RVTITCRASQGISSYLA WYQQKPGKAPKFLIYA ASTLQSGVPSRFSGSGS GTEFTLTISSLQPEDFAT YYCQQLNSYPLTFGGGT KVEIK | 140 |
| KL2B53 | KL2B53_VH | EVQLVESGGGVVQP GRSLRLSCVASGFTFS SYDIHWVRQAPGKGL EWVAIISYDGSKKDYT DSVKGRFTISRDNSKN TLYLQMDSLRVEDSA VYSCARESGWSHYYY YGMDVWGQGTMVT VSS | 141 | KL2B53_VL | DIVMTQSPSSLSASVGD RVTITCRASQDISNYLA WYQQKPGKVPKFLIYA ASTLHSGVPSRFSGSGS GTDFTLTISSLQPEDVAT YYCQKYNSAPYTFGQGT RLEIK | 142 |
| KL2B242 | KL2B242_VH | QVQLQESGPGLVKPS ETLSLTCTVSGGSISSY YWSWLRQPAGSGLE WIGRLYVSGFTNYNP SLKSRVTLSLDPSRNQ LSLKLSSVTAADTAVY YCAGDSGNYWGWF DPWGQGTLVTVSS | 143 | KL2B242_VL | SYELTQPPSVSVSPGET ASITCSGDQLGENYAC WYQQKPGQSPVLVIYQ DSKRPSGIPERFSGSNS GNTATLTISGTQALDEA DYYCQAWDNSIVVFGG GTKLTVL | 144 |
| KL2B467 | KL2B467_VH | QVQLVESGGGVVQP GRSLRLSCAASGFTFS YYGMHWVRQAPGK | 145 | KL2B467_VL | QSVLTQPPSVSVAPGQ TASITCGGDNIGSKSVH WYQQKPGQAPVLVVY | 146 |

TABLE 15-continued

VH and VL amino acid sequences of selected anti-hK2 antibodies.

| mAb name | VH name | VH amino acid Sequence | VH SEQ ID NO: | VL name | VL amino acid sequence | VL SEQ ID NO: |
|---|---|---|---|---|---|---|
| | | GLEWVAFISYDGSNK YYADSVKGRFTISRDN SKNTLYLQMNSLRAE DTAVYYCAHLPYSGSY WAFDYWGQGTQVT VSS | | | DNSDRPSGIPERFSGSN SGTTATLTISRVEAGDEA DYYCQVWDSSSDHPVV FGGGTKVTV | |
| KL2B494 | KL2B494_VH | QVQLVESGGGLVQP GGSLRLSCAASGFTFS HYAMSWVRQAPGK GLEWVSTIGGSGGST YYADSVKGRFTISRDN SKNTLYLQMNSLRAE DTAVYYCAKPHIVMV TALLYDGMDVWGQ GTMVTVSS | 147 | KL2B494_VL | SSELTQPPSVSVAPGQT ARITCGGNNIGSKSVH WYQQKPGQAPVLVVY DDSDRPSGIPERFSGSN SGNTATLTISRVEAGDE ADYYCQVWDSSSDHVV FGGGTKLTVL | 148 |
| KL2B242 LC_C335 | KL2B242_VH | QVQLQESGPGLVKPS ETLSLTCTVSGGSISSY YWSWLRQPAGSGLE WIGRLYVSGFTNYNP SLKSRVTLSLDPSRNQ LSLKLSSVTAADTAVY YCAGDSGNYWGWF DPWGQGTLVTVSS | 143 | KL2B242_LC_C335_VL | SYELTQPPSVSVSPGET ASITCSGDQLGENYAS WYQQKPGQSPVLVIYQ DSKRPSGIPERFSGSNS GNTATLTISGTQALDEA DYYCQAWDNSIVVFGG GTKLTVL | 358 |

TABLE 16

Kabat HCDR1, HCDR2 and HCDR3 amino acid sequences of selected anti-KLK2 antibodies.

| | Kabat HCDR1 | | Kabat HCDR2 | | Kabat HCDR3 | |
|---|---|---|---|---|---|---|
| mAb name | Sequence | SEQ ID NO: | Sequence | SEQ ID NO: | Sequence | SEQ ID NO: |
| m11B6 | SDYAWN | 149 | YISYSGSTTYSPSLKS | 150 | GYYYGSGF | 151 |
| hu11B6 | SDYAWN | 149 | YISYSGSTTYNPSLKS | 152 | GYYYGSGF | 151 |
| HCF3-LCD6 | SDYAWN | 149 | YISYSGSTTYNPSLKS | 152 | GYYYGSGF | 151 |
| HCG5-LCB7 | SDYAWN | 149 | YISYSGSTTYNPSLKS | 152 | GYYYGSGF | 151 |
| KL2B357 | SDYAWN | 149 | YISYSGSTTYNPSLKS | 152 | GYYYGSGF | 151 |
| KL2B358 | SDYAWN | 149 | YISYSGSTTYNPSLKS | 152 | GYYYGSGF | 151 |
| KL2B359 | SDYAWN | 149 | YISYSGSTTYNPSLKS | 152 | GYYYGSGF | 151 |
| KL2B360 | SDYAWN | 149 | YISYSGSTTYNPSLKS | 152 | GYYYGSGF | 151 |
| KL2B413 | SYWMT | 153 | NIKQDGSERYYVDSVKG | 154 | DQNYDILTGHYGMDV | 155 |
| KL2B30 | SYYWS | 156 | YIYYSGSTNYNPSLKS | 157 | TTIFGVVTPNFYYGMDV | 158 |
| KL2B53 | SYNH | 159 | IISYDGSKKDYTDSVKG | 160 | ESGWSHYYYYGMDV | 161 |
| KL2B242 | SYYWS | 162 | RLYVSGFTNYNPSLKS | 163 | DSGNYWGWFDP | 164 |
| KL2B467 | YYGMH | 165 | FISYDGSNKYYADSVKG | 166 | LPYSGSYWAFDY | 167 |
| KL2B494 | HYAMS | 168 | TIGGSGGSTYYADSVKG | 169 | PHIVMVTALLYDGMDV | 170 |

TABLE 17

Kabat LCDR1, LCDR2 and LCDR3 amino acid sequences of selected anti-hK2 antibodies.

| | Kabat LCDR1 | | Kabat LCDR2 | | Kabat LCDR3 | |
|---|---|---|---|---|---|---|
| mAb name | Sequence | SEQ ID NO | Sequence | SEQ ID NO | Sequence | SEQ ID NO |
| m11B6 | RASESVEYFGTSLMH | 171 | AASNVES | 172 | QQTRKVPYT | 173 |
| hu11B6 | KASESVEYFGTSLMH | 174 | AASNRES | 175 | QQTRKVPYT | 173 |
| HCF3-LCD6 | KASESVEYFGTSLMH | 174 | AASNRES | 175 | QQTRKVPYT | 173 |
| HCG5-LCB7 | KASESVEYFGTSLMH | 174 | AASNRES | 175 | QQTRKVPYT | 173 |
| KL2B357 | RASESVEYFGTSLMH | 171 | AASNVES | 172 | QQTRKVPYT | 173 |
| KL2B358 | RASESVEYFGTSLMH | 171 | AASNVES | 172 | QQTRKVPYT | 173 |
| KL2B359 | RASESVEYFGTSLMH | 171 | AASNVES | 172 | QQTRKVPYT | 173 |
| KL2B360 | RASESVEYFGTSLMH | 171 | AASNVES | 172 | QQTRKVPYT | 173 |
| KL2B413 | RASQGISSYLS | 176 | ATSTLQS | 177 | QQLNSYPRT | 178 |
| KL2B30 | RASQGISSYLA | 182 | AASTLQS | 183 | QQLNSYPLT | 184 |
| KL2B53 | RASQDISNYLA | 179 | AASTLHS | 180 | QKYNSAPYT | 181 |
| KL2B242 | SGDQLGENYAC | 185 | QDSKRPS | 186 | QAWDNSIVV | 187 |
| KL2B467 | GGDNIGSKSVH | 720 | DNSDRPS | 721 | QVWDSSSDHPVV | 193 |
| KL2B494 | GGNNIGSKSVH | 191 | DDSDRPS | 192 | QVWDSSSDHVV | 188 |

TABLE 18

AbM HCDR1, HCDR2 and HCDR3 amino acid sequences of selected anti-hK2 antibodies.

| | AbM HCDR1 | | AbM HCDR2 | | AbM HCDR3 | |
|---|---|---|---|---|---|---|
| mAb name | Sequence | SEQ ID NO: | Sequence | SEQ ID NO | Sequence | SEQ ID NO: |
| m11B6 | GNSITSDYAWN | 194 | YISYSGSTT | 195 | GYYYGSGF | 151 |
| hu11B6 | GNSITSDYAWN | 194 | YISYSGSTT | 195 | GYYYGSGF | 151 |
| HCF3-LCD6 | GNSITSDYAWN | 194 | YISYSGSTT | 195 | GYYYGSGF | 151 |
| HCG5-LCB7 | GNSITSDYAWN | 194 | YISYSGSTT | 195 | GYYYGSGF | 151 |
| KL2B357 | GNSITSDYAWN | 194 | YISYSGSTT | 195 | GYYYGSGF | 151 |
| KL2B358 | GNSITSDYAWN | 194 | YISYSGSTT | 195 | GYYYGSGF | 151 |
| KL2B359 | GNSITSDYAWN | 194 | YISYSGSTT | 195 | GYYYGSGF | 151 |
| KL2B360 | GNSITSDYAWN | 194 | YISYSGSTT | 195 | GYYYGSGF | 151 |
| KL2B413 | GFTFSSYWMT | 189 | NIKQDGSERY | 190 | DQNYDILTGHYGMDV | 155 |
| KL2B30 | GGSISSYYWS | 202 | YIYYSGSTN | 203 | TTIFGVVTPNFYYGMDV | 158 |
| KL2B53 | GFTFSSYDIH | 196 | IISYDGSKKD | 197 | ESGWSHYYYYGMDV | 161 |
| KL2B242 | GGSISSYYWS | 198 | RLYVSGFTN | 199 | DSGNYWGWFDP | 164 |
| KL2B467 | GFTFSYY | 200 | FISYDGSNKY | 201 | LPYSGSYWAFDY | 167 |
| KL2B494 | GFTFSHYAMS | 204 | TIGGSGGSTYY | 205 | PHIVMVTALLYDGMDV | 206 |

TABLE 19

AbM LCDR1, LCDR2 and LCDR3 amino acid sequences of selected anti-hK2 antibodies.

| | AbM LCDR1 | | AbM LCDR2 | | AbM LCDR3 | |
|---|---|---|---|---|---|---|
| mAb name | Sequence | SEQ ID NO: | Sequence | SEQ ID NO | Sequence | SEQ ID NO: |
| m11B6 | RASESVEYFGTSLMH | 171 | AASNVES | 172 | QQTRKVPYT | 173 |
| hu11B6 | KASESVEYFGTSLMH | 174 | AASNRES | 175 | QQTRKVPYT | 173 |
| HCF3-LCD6 | KASESVEYFGTSLMH | 174 | AASNRES | 175 | QQTRKVPYT | 173 |
| HCG5-LCB7 | KASESVEYFGTSLMH | 174 | AASNRES | 175 | QQTRKVPYT | 173 |
| KL2B357 | RASESVEYFGTSLMH | 171 | AASNVES | 172 | QQTRKVPYT | 173 |
| KL2B358 | RASESVEYFGTSLMH | 171 | AASNVES | 172 | QQTRKVPYT | 173 |
| KL2B359 | RASESVEYFGTSLMH | 171 | AASNVES | 172 | QQTRKVPYT | 173 |
| KL2B360 | RASESVEYFGTSLMH | 171 | AASNVES | 172 | QQTRKVPYT | 173 |
| KL2B413 | RASQGISSYLS | 176 | ATSTLQS | 177 | QQLNSYPRT | 178 |
| KL2B30 | RASQGISSYLA | 182 | AASTLQS | 183 | QQLNSYPLT | 184 |
| KL2B53 | RASQDISNYLA | 179 | AASTLHS | 180 | QKYNSAPYT | 181 |
| KL2B242 | SGDQLGENYAC | 185 | QDSKRPS | 186 | QAWDNSIVV | 187 |
| KL2B467 | GGDNIGSKSVH | 720 | DNSDRPS | 192 | QVWDSSSDHPVV | 193 |
| KL2B494 | GGNNIGSKSVH | 191 | DDSDRPS | 192 | QVWDSSSDHVV | 188 |

TABLE 20

Amino acid sequences of the variable domains of selected anti-hK2 antibodies

| Antibody | Region | Amino acid sequence | SEQ ID NO: |
|---|---|---|---|
| m11B6 | HCDR1 | SDYAWN | 149 |
| | HCDR2 | YISYSGSTTYSPSLKS | 150 |
| | HCDR3 | GYYYGSGF | 151 |
| | LCDR1 | RASESVEYFGTSLMH | 171 |
| | LCDR2 | AASNVES | 172 |
| | LCDR3 | QQTRKVPYT | 173 |
| | VH (m11B6_VH) | DVQLQESGPGLVKPSQSLSLTCTVTGNSITSDYAWNWIRQFPG NRLEWMGYISYSGSTTYSPSLKSRFSITRDTSKNQFFLQLNSVTP EDTATYFCATGYYYGSGFWGQGTLVTVSS | 126 |
| | VL (m11B6_VL) | DIVLTQSPASLAVSLGQRATISCRASESVEYFGTSLMHWYRQKP GQPPKLLIYAASNVESGVPARFSGSGSGTDFSLNIQPVEEDDFS MYFCQQTRKVPYTFGGGTKLEIK | 127 |
| h11B6 | HCDR1 | SDYAWN | 149 |
| | HCDR2 | YISYSGSTTYNPSLKS | 152 |
| | HCDR3 | GYYYGSGF | 151 |
| | LCDR1 | KASESVEYFGTSLMH | 174 |
| | LCDR2 | AASNRES | 175 |
| | LCDR3 | QQTRKVPYT | 173 |
| | VH (hu11B6_VH) | QVQLQESGPGLVKPSDTLSLTCAVSGNSITSDYAWNWIRQPPG KGLEWIGYISYSGSTTYNPSLKSRVTMSRDTSKNQFSLKLSSVTA VDTAVYYCATGYYYGSGFWGQGTLVTVSS | 124 |
| | VL (hu11B6_VL) | DIVLTQSPDSLAVSLGERATINCKASESVEYFGTSLMHWYQQKP GQPPKLLIYAASNRESGVPDRFSGSGSGTDFTLTISSLQAEDVAV YYCQQTRKVPYTFGQGTKLEIK | 125 |
| HCF3-LCD6 | HCDR1 | SDYAWN | 149 |
| | HCDR2 | YISYSGSTTYNPSLKS | 152 |
| | HCDR3 | GYYYGSGF | 151 |
| | LCDR1 | KASESVEYFGTSLMH | 174 |

TABLE 20-continued

Amino acid sequences of the variable domains of selected anti-hK2 antibodies

| Antibody | Region | Amino acid sequence | SEQ ID NO: |
|---|---|---|---|
| | LCDR2 | AASNRES | 175 |
| | LCDR3 | QQTRKVPYT | 173 |
| | VH (HCF3_VH) | QVQLQESGPGLVKPSDTLSLTCAVSGNSITSDYAWNWIRQFPG KGLEWIGYISYSGSTTYNPSLKSRVTISRDTSKNQFSLKLSSVTPV DTAVYYCATGYYYGSGFWGQGTLVTVSS | 128 |
| | VL (LCD6_VL) | DIVLTQSPDSLAVSLGERATINCKASESVEYFGTSLMHWYQQKP GQPPKLLIYAASNRESGVPDRFSGSGSGTDFTLTIQSVQAEDVS VYFCQQTRKVPYTFGQGTKLEIK | 129 |
| HCG5-LCB7 | HCDR1 | SDYAWN | 149 |
| | HCDR2 | YISYSGSTTYNPSLKS | 152 |
| | HCDR3 | GYYYGSGF | 151 |
| | LCDR1 | KASESVEYFGTSLMH | 174 |
| | LCDR2 | AASNRES | 175 |
| | LCDR3 | QQTRKVPYT | 173 |
| | VH (HCG5_VH) | QVQLQESGPGLVKPSDTLSLTCAVSGNSITSDYAWNWIRQFPG KGLEWMGYISYSGSTTYNPSLKSRVTISRDTSKNQFSLKLSSVTP VDTAVYYCATGYYYGSGFWGQGTLVTVSS | 130 |
| | VL (LCB7_VL) | DIVLTQSPDSLAVSLGERATINCKASESVEYFGTSLMHWYQQKP GQPPKLLIYAASNRESGVPDRFSGSGSGTDFTLTISSVQAEDVAV YYCQQTRKVPYTFGQGTKLEIK | 131 |
| KL2B357 | HCDR1 | SDYAWN | 149 |
| | HCDR2 | YISYSGSTTYNPSLKS | 152 |
| | HCDR3 | GYYYGSGF | 151 |
| | LCDR1 | RASESVEYFGTSLMH | 171 |
| | LCDR2 | AASNVES | 172 |
| | LCDR3 | QQTRKVPYT | 173 |
| | VH (KL2B357_VH) | QVQLQESGPGLVKPSQTLSLTCTVSGNSITSDYAWNWIRQFPG KGLEWIGYISYSGSTTYNPSLKSRVTISRDTSKNQFSLKLSSVTAA DTAVYYCATGYYYGSGFWGQGTLVTVSS | 132 |
| | VL (KL2B_357_VL) | DIVLTQSPDSLAVSLGERATINCRASESVEYFGTSLMHWYQQKP GQPPKLLIYAASNVESGVPDRFSGSGSGTDFTLTISSLQAEDVAV YFCQQTRKVPYTFGGGTKVEIK | 133 |
| KL2B358 | HCDR1 | SDYAWN | 149 |
| | HCDR2 | YISYSGSTTYNPSLKS | 152 |
| | HCDR3 | GYYYGSGF | 151 |
| | LCDR1 | RASESVEYFGTSLMH | 171 |
| | LCDR2 | AASNVES | 172 |
| | LCDR3 | QQTRKVPYT | 173 |
| | VH (KL2B358_VH) | QVQLQESGPGLVKPSQTLSLTCTVSGNSITSDYAWNWIRQPPG KGLEWIGYISYSGSTTYNPSLKSRVTISRDTSKNQFSLKLSSVTAA DTAVYYCATGYYYGSGFWGQGTLVTVSS | 134 |
| | VL (KL213_358_VL) | EIVLTQSPATLSLSPGERATLSCRASESVEYFGTSLMHWYQQKP GQPPRLLIYAASNVESGIPARFSGSGSGTDFTLTISSVEPEDFAVY FCQQTRKVPYTFGGGTKVEIK | 135 |
| KL2B359 | HCDR1 | SDYAWN | 149 |
| | HCDR2 | YISYSGSTTYNPSLKS | 152 |
| | HCDR3 | GYYYGSGF | 151 |
| | LCDR1 | RASESVEYFGTSLMH | 171 |
| | LCDR2 | AASNVES | 172 |
| | LCDR3 | QQTRKVPYT | 173 |
| | VH (KL2B359_VH) | QVQLQESGPGLVKPSQTLSLTCTVSGNSITSDYAWNWIRQFPG KRLEWIGYISYSGSTTYNPSLKSRVTISRDTSKNQFSLKLSSVTAA DTAVYYCATGYYYGSGFWGQGTLVTVSS | 136 |
| | VL (KL2B_359_VL) | EIVLTQSPATLSLSPGERATLSCRASESVEYFGTSLMHWYQQKP GQPPRLLIYAASNVESGIPARFSGSGSGTDFTLTISSVEPEDFAVY FCQQTRKVPYTFGGGTKVEIK | 135 |
| KL2B360 | HCDR1 | SDYAWN | 149 |
| | HCDR2 | YISYSGSTTYNPSLKS | 152 |
| | HCDR3 | GYYYGSGF | 151 |
| | LCDR1 | RASESVEYFGTSLMH | 171 |
| | LCDR2 | AASNVES | 172 |
| | LCDR3 | QQTRKVPYT | 173 |
| | VH (KL2B360_VH) | QVQLQESGPGLVKPSQTLSLTCTVSGNSITSDYAWNWIRQFPG KGLEWIGYISYSGSTTYNPSLKSRVTISRDTSKNQFSLKLSSVTAA DTAVYYCATGYYYGSGFWGQGTLVTVSS | 132 |
| | VL (KL2B_360_VL) | EIVLTQSPATLSLSPGERATLSCRASESVEYFGTSLMHWYQQKP GQPPRLLIYAASNVESGIPARFSGSGSGTDFTLTISSVEPEDFAVY FCQQTRKVPYTFGGGTKVEIK | 135 |

TABLE 20-continued

Amino acid sequences of the variable domains of selected anti-hK2 antibodies

| Antibody | Region | Amino acid sequence | SEQ ID NO: |
|---|---|---|---|
| KL2B413 | HCDR1 | SYWMT | 153 |
| | HCDR2 | NIKQDGSERYYVDSVKG | 154 |
| | HCDR3 | DQNYDILTGHYGMDV | 155 |
| | LICDR1 | RASQGISSYLS | 176 |
| | LCDR2 | ATSTLQS | 177 |
| | LCDR3 | QQLNSYPRT | 178 |
| | VH (KL2B413_VH) | EVQLVESGGGLVQPGGSLRLSCAASGFTFSSYWMTWVRQAPG KGLEWVANIKQDGSERYYVDSVKGRFTISRDNAKNSLYLQMNS LRAEDTAVYYCARDQNYDILTGHYGMDVWGQGTTVTVSS | 137 |
| | VL (KL213_413_VL) | EIVLTQSPSFLSASVGDRVTITCRASQGISSYLSWYQQKPGKAPK LLIYATSTLQSGVPSRFSGSGSGTEFTLTISSLQPEDFATYYCQQL NSYPRTFGQGTKVEIK | 138 |
| KL2B30 | HCDR1 | SYYWS | 156 |
| | HCDR2 | YIYYSGSTNYNPSLKS | 157 |
| | HCDR3 | TTIFGVVTPNFYYGMDV | 158 |
| | LCDR1 | RASQGISSYLA | 182 |
| | LCDR2 | AASTLQS | 183 |
| | LCDR3 | QQLNSYPLT | 184 |
| | VH (KL2B30_VH) | QVQLQESGPGLVKPSETLSLTCTVSGGSISSYYWSWIRQPPGKG LEWIGYIYYSGSTNYNPSLKSRVTISVDTSKNQFSLKLSSVTAADT AVYYCAGTTIFGVVTPNFYYGMDVWGQGTTVTVSS | 139 |
| | VL (KL2B30_VL) | DIQMTQSPSFLSASVGDRVTITCRASQGISSYLAWYQQKPGKA PKFLIYAASTLQSGVPSRFSGSGSGTEFTLTISSLQPEDFATYYCQ QLNSYPLTFGGGTKVEIK | 140 |
| KL2B53 | HCDR1 | SYDIH | 159 |
| | HCDR2 | IISYDGSKKDYTDSVKG | 160 |
| | HCDR3 | ESGWSHYYYYGMDV | 161 |
| | LCDR1 | RASQDISNYLA | 179 |
| | LCDR2 | AASTLHS | 180 |
| | LCDR3 | QKYNSAPYT | 181 |
| | VH (KL2B53_VH) | EVQLVESGGGVVQPGRSLRLSCVASGFTFSSYDIHWVRQAPGK GLEWVAIISYDGSKKDYTDSVKGRFTISRDNSKNTLYLQMDSLR VED SAVYSCARESGWSHYYYYGMDVWGQGTMVTVSS | 141 |
| | VL (KL2B53_VL) | DIVMTQSPSSLSASVGDRVTITCRASQDISNYLAWYQQKPGKV PKFLIYAASTLHSGVPSRFSGSGSGTDFTLTISSLQPEDVATYYCQ KYNSAPYTFGQGTRLEIK | 142 |
| KL2B242 | HCDR1 | SYYWS | 162 |
| | HCDR2 | RLYVSGFTNYNPSLKS | 163 |
| | HCDR3 | DSGNYWGWFDP | 164 |
| | LCDR1 | SGDQLGENYAC | 185 |
| | LCDR2 | QDSKRPS | 186 |
| | LCDR3 | QAWDNSIVV | 187 |
| | VH (KL2B242_VH) | QVQLQESGPGLVKPSETLSLTCTVSGGSISSYYWSWLRQPAGS GLEWIGRLYVSGFTNYNPSLKSRVTLSLDPSRNQLSLKLSSVTAA DTAVYYCAGDSGNYWGWFDPWGQGTLVTVSS | 143 |
| | VL (KL2B242_VL) | SYELTQPPSVSVSPGETASITCSGDQLGENYACWYQQKPGQSP VLVIYQDSKRPSGIPERFSGSNSGNTATLTISGTQALDEADYYCQ AWDNSIVVFGGGTKLTVL | 144 |
| KL2B467 | HCDR1 | YYGMH | 165 |
| | HCDR2 | FISYDGSNKYYADSVKG | 166 |
| | HCDR3 | LPYSGSYWAFDY | 167 |
| | LCDR1 | GGDNIGSKSVH | 191 |
| | LCDR2 | DNSDRPS | 721 |
| | LCDR3 | QVWDSSSDHPVV | 193 |
| | VH (KL2B467_VH) | QVQLVESGGGVVQPGRSLRLSCAASGFTFSYYGMHWVRQAP GKGLEWVAFISYDGSNKYYADSVKGRFTISRDNSKNTLYLQMN SLRAEDTAVYYCAHLPYSGSYWAFDYWGQGTQVTVSS | 145 |
| | VL (KL2B467_VL) | QSVLTQPPSVSVAPGQTASITCGGDNIGSKSVHWYQQKPGQA PVLVVYDNSDRPSGIPERFSGSNSGTTATLTISRVEAGDEADYYC QVWDSSSDHPVVFGGGTKVTV | 146 |
| KL2B494 | HCDR1 | HYAMS | 168 |
| | HCDR2 | TIGGSGGSTYYADSVKG | 169 |
| | HCDR3 | PHIVMVTALLYDGMDV | 170 |
| | LCDR1 | GGNNIGSKSVH | 191 |

TABLE 20-continued

| Amino acid sequences of the variable domains of selected anti-hK2 antibodies | | | |
|---|---|---|---|
| Antibody | Region | Amino acid sequence | SEQ ID NO: |
| | LCDR2 | DDSDRPS | 192 |
| | LCDR3 | QVWDSSSDHVV | 188 |
| | VH (KL2B494_VH) | QVQLVESGGGLVQPGGSLRLSCAASGFTFSHYAMSWVRQAPG KGLEWVSTIGGSGGSTYYADSVKGRFTISRDNSKNTLYLQMNSL RAEDTAVYYCAKPHIVMVTALLYDGMDVWGQGTMVTVSS | 147 |
| | VL (KL2B494_VL) | SSELTQPPSVSVAPGQTARITCGGNNIGSKSVHWYQQKPGQA PVLVVYDDSDRPSGIPERFSGSNSGNTATLTISRVEAGDEADYYC QVWDSSSDHVVFGGGTKLTVL | 148 |

TABLE 21

SEQ ID NOs for protein and DNA sequences of the VH and VL domains of selected hK2 antibodies.

| Antibody | VH Protein SEQ ID NO: | VL Protein SEQ ID NO | VH cDNA SEQ ID NO: | VL cDNA SEQ ID NO: |
|---|---|---|---|---|
| m11B6 | 126 | 127 | 225 | 237 |
| hu11B6 | 124 | 125 | 226 | 238 |
| HCF3-LCD6 | 128 | 129 | 227 | 239 |
| HCG5-LCB7 | 130 | 131 | 228 | 240 |
| KL2B357 | 132 | 133 | 229 | 241 |
| KL2B358 | 134 | 135 | 230 | 242 |
| KL2B359 | 139 | 135 | 231 | 242 |
| KL2B360 | 132 | 135 | 229 | 242 |
| KL2B413 | 137 | 138 | 230 | 243 |
| KL2B30 | 139 | 140 | 231 | 244 |
| KL2B53 | 141 | 142 | 234 | 245 |
| KL2B242 | 143 | 144 | 361 | 246 |
| KL2B467 | 145 | 146 | 362 | 247 |
| KL2B494 | 147 | 148 | 235 | 236 |

SEQ ID NO: 225 (m11B6 VH cDNA)
GATGTGCAGCTTCAGGAGTCTGGACCCGGACTTGTTAAACCAAGTCAGTCTCTGTCCCTGAC
CTGTACCGTCACCGGCAACAGCATCACAAGCGATTACGCATGGAACTGGATCAGGCAGTTCC
CTGGAAATCGACTCGAATGGATGGGCTACATTTCATACTCCGGTTCAACCACTTACTCTCCAT
CCTTGAAATCTAGGTTCAGCATCACCCGTGATACCTCAAAGAACCAATTTTTTCTGCAACTG
AATAGCGTAACTCCAGAGGACACAGCCACATATTTCTGCGCCACTGGGTATTACTATGGCTC
AGGTTTCTGGGGTCAGGGCACTCTCGTCACCGTCAGCAGC

SEQ ID NO: 226 (hu11B6 VH cDNA)
CAGGTCCAACTGCAAGAGAGCGGACCGGGCCTGGTAAAGCCATCCGACACATTGTCCCTGA
CGTGTGCGGTAAGTGGAAACTCTATCACTAGCGACTATGCGTGGAATTGGATAAGACAACC
GCCGGGCAAGGGGCTGGAATGGATAGGATATATCAGCTATTCCGGTTCTACGACATACAATC
CTTCCCTGAAAAGCAGAGTCACTATGTCACGCGACACGTCCAAGAATCAGTTCTCATTGAAA
TTGTCATCCGTAACGGCCGTTGACACTGCGGTTTATTATTGCGCAACCGGATATTACTACGGC
TCTGGTTTTTGGGGACAGGGAACACTTGTTACTGTTAGTTCA

SEQ ID: NO 227 (HCF3-LCD6 VH cDNA)
CAGGTGCAGCTGCAGGAGAGCGGCCCAGGCCTGGTGAAGCCAAGCGACACCCTGAGCCTGA
CCTGCGCCGTGAGCGGCAACAGCATCACCAGCGACTACGCCTGGAACTGGATCCGCCAGTTC
CCAGGCAAGGGCCTGGAGTGGATCGGCTACATCAGCTACAGCGGCAGCACCACCTACAACC
CAAGCCTGAAGAGCCGCGTCACCATCAGCCGCGACACCAGCAAGAACCAGTTCAGCCTGAA
GCTGAGCAGCGTGACCCCTGTGGACACCGCCGTGTACTACTGCGCCACCGGCTACTACTACG
GCAGCGGCTTCTGGGGCCAGGGCACCCTGGTGACCGTGAGCAGC

TABLE 21-continued

SEQ ID NOs for protein and DNA sequences of the VH and VL domains of selected hK2 antibodies.

SEQ ID NO: 228 (HCG5-LCB7 VH cDNA)
CAGGTGCAGCTGCAGGAGAGCGGCCCAGGCCTGGTGAAGCCAAGCGACACCCTGAGCCTGA
CCTGCGCCGTGAGCGGCAACAGCATCACCAGCGACTACGCCTGGAACTGGATCCGCCAGTTC
CCAGGCAAGGGCCTGGAGTGGATGGGCTACATCAGCTACAGCGGCAGCACCACCTACAACC
CAAGCCTGAAGAGCCGCGTCACCATCAGCCGCGACACCAGCAAGAACCAGTTCAGCCTGAA
GCTGAGCAGCGTGACCCCTGTGGACACCGCCGTGTACTACTGCGCCACCGGCTACTACTACG
GCAGCGGCTTCTGGGGCCAGGGCACCCTGGTGACCGTGAGCAGC

SEQ ID NO: 229 (KL2B357, KL2B360 VH cDNA)
CAGGTTCAGCTGCAAGAGTCTGGACCAGGCCTGGTCAAGCCCTCTCAGACCCTGTCTCTGAC
CTGTACCGTGTCCGGCAACTCCATCACCTCTGACTACGCCTGGAACTGGATTCGGCAGTTCC
CTGGCAAGGGCCTTGAGTGGATCGGCTACATCTCCTACTCCGGTTCCACCACCTACAACCCC
AGCCTGAAGTCCCGGGTCACCATCTCCCGCGACACCTCCAAGAACCAGTTCTCCCTGAAGCT
GTCCTCCGTGACCGCTGCTGATACCGCCGTGTACTACTGTGCCACCGGCTACTACTACGGCTC
CGGCTTTTGGGGACAGGGCACACTGGTTACCGTGTCTAGT

SEQ ID NO: 230 (KL2B358 VH cDNA)
CAGGTTCAGCTGCAAGAGTCTGGACCAGGCCTGGTCAAGCCCTCTCAGACCCTGTCTCTGAC
CTGTACCGTGTCCGGCAACTCCATCACCTCTGACTACGCCTGGAACTGGATTCGGCAGCCAC
CTGGCAAGGGCCTTGAGTGGATCGGCTACATCTCCTACTCCGGTTCCACCACCTACAACCCC
AGCCTGAAGTCCCGGGTCACCATCTCCCGCGACACCTCCAAGAACCAGTTCTCCCTGAAGCT
GTCCTCCGTGACCGCTGCTGATACCGCCGTGTACTACTGTGCCACCGGCTACTACTACGGCTC
CGGCTTTTGGGGACAGGGCACACTGGTTACCGTGTCTAGT

SEQ ID NO: 231 (KL2B359 VH cDNA)
CAGGTTCAGCTGCAAGAGTCTGGACCAGGCCTGGTCAAGCCCTCTCAGACCCTGTCTCTGAC
CTGTACCGTGTCCGGCAACTCCATCACCTCTGACTACGCCTGGAACTGGATTCGGCAGTTCC
CTGGCAAGCGCCTTGAGTGGATCGGCTACATCTCCTACTCCGGTTCCACCACCTACAACCCC
AGCCTGAAGTCCCGGGTCACCATCTCCCGCGACACCTCCAAGAACCAGTTCTCCCTGAAGCT
GTCCTCCGTGACCGCTGCTGATACCGCCGTGTACTACTGTGCCACCGGCTACTACTACGGCTC
CGGCTTTTGGGGACAGGGCACACTGGTTACCGTGTCTAGT

SEQ ID NO: 232 (KL2B413 VH cDNA)
GAGGTGCAACTTGTGGAGAGCGGCGGAGGTCTGGTCCAACCCGGAGGAAGTCTCCGTCTCT
CCTGTGCTGCTAGTGGCTTCACTTTCAGCTCATATTGGATGACATGGGTGAGACAAGCCCCA
GGAAAGGGGCTCGAGTGGGTAGCTAACATTAAACAGGACGGCTCCGAACGGTACTATGTTG
ATTCTGTGAAGGGACGGTTCACTATATCCAGGGATAATGCAAAAAATTCACTCTATCTTCAA
ATGAACTCACTCAGAGCAGAGGACACTGCCGTGTATTATTGCGCCAGGGATCAAAATTATGA
CATACTGACCGGTCATTATGGAATGGATGTTTGGGGCCAGGGAACAACCGTTACCGTCTCAA
GT

SEQ ID NO: 233 (KL2B30 VH cDNA)
CAGGTGCAGCTGCAGGAGTCGGGCCCAGGACTGGTGAAGCCTTCGGAGACCCTGTCCCTCA
CCTGCACTGTCTCTGGTGGCTCCATCAGTAGTTACTATTGGAGCTGGCTCCGGCAGCCCGCC
GGGTCGGGACTGGAGTGGATTGGGCGTTTATATGTCAGTGGGTTCACCAACTACAACCCCTC
CCTCAAGAGTCGAGTCACCTTGTCACTAGACCCGTCCAGGAACCAGTTGTCCCTGAAACTGA
GTTCTGTGACCGCCGCGGACACGGCCGTATATTATTGTGCGGGAGATAGTGGGAACTACTGG
GGTTGGTTCGACCCCTGGGGCCAGGGAACCCTGGTCACCGTCTCCTCA

SEQ ID NO: 234 (KL2B53 VH cDNA)
GAGGTGCAGCTGGTGGAGTCTGGGGGAGGCGTGGTCCAGCCTGGGAGGTCCCTGAGACTCT
CCTGTGTAGCCTCTGGATTCACCTTCAGTAGTTATGACATACACTGGGTCCGCCAGGCTCCA
GGCAAGGGGCTGGAGTGGGTGGCAATTATTTCATATGATGGAAGTAAAAAAGACTATACAG
ACTCCGTGAAGGGCCGATTCACCATCTCCAGAGACAATTCCAAGAACACGCTGTATCTGCAA
ATGGACAGCCTGAGAGTTGAGGACTCGGCTGTGTATTCCTGTGCGAGAGAAAGTGGCTGGTC
CCACTACTACTATTACGGTATGGACGTCTGGGGCCAAGGGACAATGGTCACCGTCTCTTCA

SEQ ID NO: 361 (KL2B242 VH cDNA)
CAGGTGCAGCTGCAGGAGTCGGGCCCAGGACTGGTGAAGCCTTCGGAGACCCTGTCCCTCA
CCTGCACTGTCTCTGGTGGCTCCATCAGTAGTTACTATTGGAGCTGGCTCCGGCAGCCCGCC
GGGTCGGGACTGGAGTGGATTGGGCGTTTATATGTCAGTGGGTTCACCAACTACAACCCCTC
CCTCAAGAGTCGAGTCACCTTGTCACTAGACCCGTCCAGGAACCAGTTGTCCCTGAAACTGA
GTTCTGTGACCGCCGCGGACACGGCCGTATATTATTGTGCGGGAGATAGTGGGAACTACTGG
GGTTGGTTCGACCCCTGGGGCCAGGGAACCCTGGTCACCGTCTCCTCA

SEQ ID NO: 724 (KL2B467 VH cDNA)
CAGGTGCAGCTGGTGGAGTCTGGGGGAGGCGTGGTCCAGCCTGGGAGGTCCCTGAGACTCT
CCTGTGCAGCCTCTGGATTCACCTTCAGTTACTATGGCATGCACTGGGTCCGCCAGGCTCCA
GGCAAGGGGCTGGAGTGGGTGGCATTTATATCATATGATGGAAGTAATAAATACTATGCAG
ACTCCGTGAAGGGCCGATTCACCATCTCCAGAGACAATTCCAAGAACACGCTGTATCTGCAA
ATGAACAGCCTGAGAGCTGAGGACACGGCTGTGTATTACTGTGCCCACCTCCCTTATAGTGG
GAGCTACTGGGCCTTTGACTACTGGGGCCAGGGAACCCAGGTCACCGTCTCTTCA

SEQ ID NO: 235 (KL2B494 VH cDNA)
CAGGTGCAGCTGGTGGAGTCTGGGGGAGGCTTGGTACAGCCTGGGGGGTCCCTGAGACTCT
CCTGTGCAGCCTCTGGATTCACCTTTAGTCATTATGCCATGAGCTGGGTCCGCCAGGCTCCAG

TABLE 21-continued

| SEQ ID NOs for protein and DNA sequences of the VH and VL domains of selected hK2 antibodies. |
|---|
| GGAAGGGGCTGGAGTGGGTCTCAACTATTGGTGGTAGTGGTGGTAGCACATACTACGCAGA<br>CTCCGTGAAGGGCCGGTTCACCATCTCCAGAGACAATTCCAAGAACACGCTGTATCTGCAAA<br>TGAACAGCCTGAGAGCCGAGGACACGGCCGTATATTACTGTGCGAAACCTCATATTGTAATG<br>GTGACTGCTCTTCTCTACGACGGTATGGACGTCTGGGGCCAAGGGACAATGGTCACCGTCTC<br>CTCA |
| SEQ ID NO: 237 (m11B6 VL cDNA)<br>GACATTGTGCTGACACAGAGTCCAGCATCCTTGGCAGTATCTTTGGGGCAGCGGGCAACAAT<br>TTCATGCCGTGCATCTGAAAGTGTGGAGTATTTTGGAACTTCTCTTATGCACTGGTATCGCCA<br>GAAGCCTGGGCAGCCTCCCAAACTCCTTATATATGCCGCTTCCAACGTGGAGTCCGGAGTAC<br>CAGCACGCTTTTCCGGCTCTGGGTCCGGCACAGACTTTTCCCTCAATATCCAACCTGTTGAAG<br>AAGACGATTTTTCCATGTATTTTTGCCAACAGACACGCAAGGTTCCATATACATTCGGCGGC<br>GGCACTAAACTTGAGATCAAA |
| SEQ ID NO: 238 (hu11B6 VL cDNA)<br>GACATAGTCTTGACTCAGAGCCCGGATTCCCTTGCTGTGTCTCTGGGAGAACGAGCTACGAT<br>CAACTGCAAGGCAAGTGAATCCGTAGAATACTTCGGGACATCATTGATGCATTGGTATCAAC<br>AGAAACCGGGGCAACCGCCCAAATTGCTGATATATGCGGCTAGTAATAGAGAATCAGGAGT<br>ACCGGATAGGTTTAGTGGTTCAGGATCAGGTACAGATTTCACCCTGACAATAAGTAGCTTGC<br>AAGCCGAAGACGTAGCAGTGTATTACTGCCAACAAACCCGAAAGGTGCCATATACGTTTGG<br>ACAGGGTACAAAGTTGGAAATCAAA |
| SEQ ID NO: 239 (HCF3-LCD6 VL cDNA)<br>GACATCGTGCTGACCCAGAGCCCAGACAGCCTGGCCGTGAGCCTGGGCGAGCGCGCCACCA<br>TCAACTGCAAGGCCAGCGAGAGCGTGGAGTACTTCGGCACCAGCCTGATGCACTGGTACCA<br>GCAGAAGCCAGGCCAGCCACCAAAGCTGCTGATCTACGCTGCCAGCAACCGCGAGAGCGGC<br>GTGCCAGACCGCTTCAGCGGCAGCGGCAGCGGCACCGACTTCACCCTGACCATCCAGAGCG<br>TGCAGGCCGAGGACGTCTCCGTGTACTTCTGCCAGCAGACCCGCAAGGTGCCATACACCTTC<br>GGCCAGGGCACCAAGCTGGAGATCAAG |
| SEQ ID NO: 240 (HCG5-LCB7 VL cDNA)<br>GACATCGTGCTGACCCAGAGCCCAGACAGCCTGGCCGTGAGCCTGGGCGAGCGCGCCACCA<br>TCAACTGCAAGGCCAGCGAGAGCGTGGAGTACTTCGGCACCAGCCTGATGCACTGGTACCA<br>GCAGAAGCCAGGCCAGCCACCAAAGCTGCTGATCTACGCTGCCAGCAACCGCGAGAGCGGC<br>GTGCCAGACCGCTTCAGCGGCAGCGGCAGCGGCACCGACTTCACCCTGACCATCAGCAGCG<br>TGCAGGCCGAGGACGTCGCCGTGTACTACTGCCAGCAGACCCGCAAGGTGCCATACACCTTC<br>GGCCAGGGCACCAAGCTGGAGATCAAG |
| SEQ ID NO: 241 (KL2B357 VL cDNA)<br>GACATCGTGCTGACCCAGTCTCCAGACTCTCTGGCTGTGTCTCTGGGCGAGAGAGCCACCAT<br>CAACTGCAGAGCCTCCGAGTCCGTGGAATACTTCGGCACCTCTCTGATGCACTGGTACCAGC<br>AGAAGCCCGGCCAGCCTCCTAAGCTGCTGATCTACGCCGCCTCCAACGTGGAATCTGGCGTG<br>CCCGATAGATTTTCCGGCTCTGGCTCTGGCACCGACTTTACCCTGACCATCAGCTCTCTGCAG<br>GCCGAGGATGTGGCCGTGTACTTCTGTCAGCAGACCCGGAAGGTGCCCTACACATTTGGCGG<br>CGGAACAAAGGTGGAAATCAAG |
| SEQ ID NO: 242 (KL2B358, KL2B359, KL2B360 VL cDNA)<br>GAGATCGTGCTGACCCAGTCTCCTGCCACACTGTCACTGTCTCCAGGCGAGAGAGCCACCCT<br>CTCTTGTAGAGCCTCCGAGTCCGTGGAATACTTCGGCACCTCTCTGATGCACTGGTACCAGC<br>AGAAGCCCGGCCAGCCTCCTAGACTGCTGATCTACGCCGCCTCCAACGTCGAATCTGGCATC<br>CCCGCTAGATTCTCCGGCTCTGGCTCTGGCACAGACTTTACCCTGACCATCTCCTCCGTGGAA<br>CCCGAGGATTTCGCTGTGTACTTTTGCCAGCAGACCCGGAAGGTGCCCTACACATTTGGCGG<br>CGGAACAAAGGTGGAAATCAAG |
| SEQ ID NO: 243 (KL2B413 VL cDNA)<br>GAAATCGTACTGACCCAGTCCCCTTCTTTCTTGAGTGCATCAGTTGGGGATAGAGTGACCAT<br>TACTTGTAGAGCATCTCAAGGTATTTCTTCATACTTGTCTTGGTATCAACAAAAACCTGGCAA<br>GGCACCCAAACTCTTGATCTACGCCACCTCTACATTGCAAAGTGGGGTTCCTTCTAGGTTTTC<br>AGGCTCCGGCTCTGGTACCGAGTTCACCCTCACTATAAGCAGTCTCCAACCTGAAGATTTCG<br>CTACTTATTATTGTCAGCAGCTTAATTCTTATCCCCGAACCTTTGGTCAAGGAACTAAGGTCG<br>AGATCAAA |
| SEQ ID NO: 244 (KL2B30 VL cDNA)<br>GACATCCAGATGACCCAGTCTCCTTCCTTCCTGTCTGCATCTGTAGGAGACAGAGTCACCAT<br>CACTTGCCGGGCCAGTCAGGGCATTAGCAGTTATTTAGCCTGGTATCAGCAAAAACCAGGGA<br>AAGCCCCTAAGTTCCTGATCTATGCTGCATCCACTTTGCAAAGTGGGGTCCCATCAAGGTTC<br>AGCGGCAGTGGATCTGGGACAGAATTCACTCTCACAATCAGCAGCCTGCAGCCTGAAGATTT<br>TGCAACTTATTACTGTCAACAGCTTAATAGTTACCCTCTCACTTTCGGCGGAGGGACCAAGG<br>TGGAAATCAAA |
| SEQ ID NO: 245 (KL2B53 VL cDNA)<br>GACATCGTGATGACCCAGTCTCCATCCTCCCTGTCTGCATCTGTAGGAGACAGAGTCACCAT<br>CACTTGCCGGGCGAGTCAGGACATTAGCAATTATTTAGCCTGGTATCAGCAGAAACCAGGG<br>AAAGTTCCTAAGTTCCTGATCTATGCTGCATCCACTTTGCACTCTGGGGTCCCATCTCGGTTC<br>AGTGGCAGTGGATCTGGGACAGATTTCACTCTCACCATCAGCAGCCTGCAGCCTGAAGATGT<br>TGCAACTTATTACTGTCAAAAGTATAACAGTGCCCCGTACACTTTTGGCCAAGGGACACGAC<br>TGGAGATTAAA |

TABLE 21-continued

SEQ ID NOs for protein and DNA sequences of the VH and VL domains of selected hK2 antibodies.

SEQ ID NO: 246 (KL2B242 VL cDNA)
TCCTATGAGCTGACTCAGCCACCCTCAGTGTCCGTGTCCCCAGGAGAGACAGCCAGCATCAC
CTGCTCTGGAGATCAATTGGGGGAAAATTATGCTTGCTGGTATCAGCAGAAGCCAGGCCAGT
CCCCTGTGTTGGTCATCTATCAAGATAGTAAGCGGCCCTCAGGGATCCCTGAGCGATTCTCT
GGCTCCAACTCTGGGAACACAGCCACTCTGACCATCAGCGGGACCCAGGCTCTGGATGAGG
CTGACTATTACTGTCAGGCGTGGGACAACAGTATTGTGGTATTCGGCGGAGGGACCAAGCTG
ACCGTCCTA

SEQ ID NO: 247 (KL2B467 VL cDNA)
CAGTCTGTGCTGACTCAGCCACCCTCGGTGTCAGTGGCCCCGGGCAGACGGCCAGTATTAC
CTGTGGGGGAGACAACATTGGAAGTAAAAGTGTGCACTGGTACCAGCAGAAGCCAGGCCAG
GCCCCTGTGCTGGTCGTCTATGATAATAGCGACCGGCCCTCAGGGATCCCTGAGCGATTCTC
TGGCTCCAACTCTGGGACCACGGCCACCCTGACCATCAGCAGGGTCGAAGCCGGGGATGAG
GCCGACTATTACTGTCAGGTGTGGGATAGTAGTAGTGATCATCCTGTGGTATTCGGCGGAGG
GACCAAGGTCACCGTCCTA

SEQ ID: 235 (KLK2B494_VH DNA)
CAGGTGCAGCTGGTGGAGTCTGGGGGAGGCTTGGTACAGCCTGGGGGGTCCCTGAGACTCT
CCTGTGCAGCCTCTGGATTCACCTTTAGTCATTATGCCATGAGCTGGGTCCGCCAGGCTCCAG
GGAAGGGGCTGGAGTGGGTCTCAACTATTGGTGGTAGTGGTGGTAGCACATACTACGCAGA
CTCCGTGAAGGGCCGGTTCACCATCTCCAGAGACAATTCCAAGAACACGCTGTATCTGCAAA
TGAACAGCCTGAGAGCCGAGGACACGGCCGTATATTACTGTGCGAAACCTCATATTGTAATG
GTGACTGCTCTTCTCTACGACGGTATGGACGTCTGGGGCCAAGGGACAATGGTCACCGTCTC
CTCA

SEQ ID: 236 (KLK2B494_VL DNA)
TCTTCTGAGCTGACTCAGCCACCCTCGGTGTCAGTGGCCCCAGGACAGACGGCCAGGATTAC
CTGTGGGGGAAACAACATTGGAAGTAAAAGTGTGCACTGGTACCAGCAGAAGCCAGGCCAG
GCCCCTGTGCTGGTCGTCTATGATGATAGCGACCGGCCCTCAGGGATCCCTGAGCGATTCTC
TGGCTCCAACTCTGGGAACACGGCCACCCTGACCATCAGCAGGGTCGAAGCCGGGGATGAG
GCCGACTATTACTGTCAGGTGTGGGATAGTAGTAGTGATCATGTGGTATTCGGCGGAGGGAC
CAAGCTGACCGTCCTA

Consensus VH and VL Sequences

FIG. 5 shows the sequence alignment of the VH domains of mu11B6, hu11B6, KL2B357, KL2B358, KL2B359, KL2B360, HCF3 and HCG5. FIG. 6 shows the sequence alignment of the VL domains of mu11B6, hu11B6, KL2B357, KL2B358, KL2B359, KL2B360, LDC6 and LCB7. Consensus amino acid sequence of SEQ ID NO: 356 and SEQ ID NO:357 were determined for the VH and VL domains, respectively. HCDR and LCDR residues are underlined.

SEQ ID NO: 356

$\text{QVQLQESGPGLVKPSX}_1\text{TLSLTCX}_2\text{VS}\underline{\text{GNSITSDYAWN}}\text{WIRQX}_3\text{PGKX}_4\text{LE}$ $\text{WX}_5\text{G}\underline{\text{YISYSGSTT}}\text{YNPSLKSRVTX}_6\text{SRDTSKNQFSLKLSSVTX}_7\text{X}_8\text{DTAVY}$

YCATGYYYGSGFWGQGTLVTVSS wherein, $X_1$ is D or Q; $X_2$ is A or T; $X_3$ is P or F; $X_4$ is G or R; $X_5$ is I or M; $X_6$ is I or M; $X_7$ is A or P; or $X_8$ is V or A.

SEQ ID NO: 357

$\text{X}_1\text{IVLTQSPX}_2\text{X}_3\text{LX}_4\text{X}_5\text{SX}_6\text{GERATX}_7\text{X}_8\text{C}\underline{\text{X}_9\text{ASESVEYFGTSLMH}}\text{WYQQ}$ $\text{KPGQPPX}_{10}\text{LLIY}\underline{\text{AASNX}_{11}\text{ES}}\text{GX}_{12}\text{PX}_{13}\text{RFSGSGSGTDFTLTIX}_{14}\text{S}$ $\text{X}_{15}\text{X}_{16}\text{QX}_{17}\text{EDX}_{18}\text{X}_{19}\text{VYX}_{20}\text{C}\underline{\text{QQTRKVPYT}}\text{FGX}_{21}\text{GTKX}_{22}\text{EIK}$ wherein, $X_1$ is D or E; $X_2$ is D or A; $X_3$ is S or T; $X_4$ is A or S; $X_5$ is V or L; $X_6$ is L or P; $X_7$ is I or L; $X_8$ is N or S; $X_9$ is R or K; $X_{10}$ is K or R; $X_{11}$ is V or R; $X_{12}$ is V or I; $X_{13}$ is A or D; $X_{14}$ is Q or S; $X_{15}$ is L or V; $X_{16}$ is Q or E; $X_{17}$ is P or A; $X_{18}$ is F or V; $X_{19}$ is A or S, $X_{20}$ is Y or F; $X_{21}$ is Q or G; and $X_{22}$ is L or V.

Fab-Fc and scFvs

The hK2 specific VH/VL regions were engineered as VH-CH1-linker CH2-CH3 and VL-CL and expressed as IgG2 or IgG4 or were engineered as scFvs in either the VH-Linker-VL or VL-linker-VH orientations. The linker that is used in the scFv was the linker of SEQ ID NO: 31 described above. The scFv were used to generate bispecific antibodies as described in Example 3.

Table 22 shows the HC amino acid sequences of selected anti-hK2 antibodies in the mAb format. Table 23 shows the LC amino acid sequences of selected anti-hK2 antibodies in a mAb. Table 24 summaries the HC and LC DNA SEQ ID NOs of selected anti-hK2 antibodies in the mAb format. Table 25 shows the amino acid sequences of selected scFvs in VH-linker-VL or VL-linker-VH orientation.

TABLE 22

Amino acid sequence of the HC (VH-CH1-linker CH2-CH3) of selected anti-hK2 antibodies in a mAb format.

| KLK2 HEAVY CHAIN | HC PROTEIN SEQ ID NO: | HC AMINO ACID SEQUENCE |
|---|---|---|
| m11B6_HC | 207 | DVQLQESGPGLVKPSQSLSLTCTVTGNSITSDYAWNWIRQFPGNRLEWMGYISYSG<br>STTYSPSLKSRFSITRDTSKNQFFLQLNSVTPEDTATYFCATGYYYGSGFWGQGTLVT<br>VSSAKTTAPSVYPLAPVCGDTTGSSVTLGCLVKGYFPEPVTLTWNSGSLSSGVHTFP<br>AVLQSDLYTLSSSVTVTSSTWPSQSITCNVAHPASSTKVDKKIEPRGPTIKPCPPCKCP<br>APNLLGGPSVFIFPPKIKDVLMISLSPIVTCVVVDVSEDDPDVQISWFVNNVEVHTA<br>QTQTHREDYNSTLRVVSALPIQHQDWMSGKEFKCKVNNKDLPAPIERTISKPKGSV<br>RAPQVYVLPPPEEEMTKKQVTLTCMVTDFMPEDIYVEWTNNGKTELNYKNTEPVL<br>DSDGSYFMYSKLRVEKKNWVERNSYSCSVVHEGLHNHHTTKSFSRTPGK<br>QVQLQESGPGLVKPSDTLSLTCAVSGNSITSDYAWNWIRQPPGKGLEWIGYISYSGS<br>TTYNPSLKSRVTMSRDTSKNQFSLKLSSVTAVDTAVYYCATGYYYGSGFWGQGTLV<br>TVSSASTKGPSVFPLAPSSKSTSGGTAALGCLVKDYFPEPVTVSWNSGALTSGVHTF<br>PAVLQSSGLYSLSSVVTVPSSSLGTQTYICNVNHKPSNTKVDKKVEPKSCDKTHTCPP |
| h11B6_HC | 208 | CPAPELLGGPSVFLFPPKPKDTLMISRTPEVTCVVVDVSHEDPEVKFNWYVDGVEV<br>HNAKTKPREEQYNSTYRVVSVLTVLHQDWLNGKEYKCKVSNKALPAPIEKTISKAKG<br>QPREPQVYTLPPSREEMTKNQVSLTCLVKGFYPSDIAVEWESNGQPENNYKTTPPV<br>LDSDGSFFLYSKLTVDKSRWQQGNVFSCSVMHEALHNHYTQKSLSLSPGK<br>QVQLQESGPGLVKPSETLSLTCTVSGGSISSYYWSWIRQPPGKGLEWIGYIYYSGSTN<br>YNPSLKSRVTISVDTSKNQFSLKLSSVTAADTAVYYCAGTTIFGVVTPNFYYGMDVW<br>GQGTTVTVSSASTKGPSVFPLAPCSRSTSESTAALGCLVKDYFPEPVTVSWNSGALT<br>SGVHTFPAVLQSSGLYSLSSVVTVPSSSLGTKTYTCNVDHKPSNTKVDKRVESKYGPP |
| KL2B30_HC | 210 | CPPCPAPEAAGGPSVFLFPPKPKDTLMISRTPEVTCVVVDVSQEDPEVQFNWYVDG<br>VEVHNAKTKPREEQFNSTYRVVSVLTVLHQDWLNGKEYKCKVSNKGLPSSIEKTISK<br>AKGQPREPQVYTLPPSQEEMTKNQVSLTCLVKGFYPSDIAVEWESNGQPENNYKTT<br>PPVLDSDGSFFLYSRLTVDKSRWQEGNVFSCSVMHEALHNHYTQKSLSLSLGK<br>EVQLVESGGGVVQPGRSLRLSCVASGFTFSSYDIHWVRQAPGKGLEWVAIISYDGS<br>KKDYTDSVKGRFTISRDNSKNTLYLQMDSLRVEDSAVYSCARESGWSHYYYYGMDV<br>WGQGTMVTVSSASTKGPSVFPLAPCSRSTSESTAALGCLVKDYFPEPVTVSWNSGA<br>LTSGVHTFPAVLQSSGLYSLSSVVTVPSSSLGTKTYTCNVDHKPSNTKVDKRVESKYG |
| K2B53_HC | 211 | PPCPPCPAPEAAGGPSVFLFPPKPKDTLMISRTPEVTCVVVDVSQEDPEVQFNWYV<br>DGVEVHNAKTKPREEQFNSTYRVVSVLTVLHQDWLNGKEYKCKVSNKGLPSSIEKTI<br>SKAKGQPREPQVYTLPPSQEEMTKNQVSLTCLVKGFYPSDIAVEWESNGQPENNY<br>KTTPPVLDSDGSFFLYSRLTVDKSRWQEGNVFSCSVMHEALHNHYTQKSLSLSLGK<br>QVQLQESGPGLVKPSETLSLTCTVSGGSISSYYWSWLRQPAGSGLEWIGRLYVSGFT<br>NYNPSLKSRVTLSLDPSRNQLSLKLSSVTAADTAVYYCAGDSGNYWGWFDPWGQG<br>TLVTVSSASTKGPSVFPLAPCSRSTSESTAALGCLVKDYFPEPVTVSWNSGALTSGVH |
| KL2B242_HC | 212 | TFPAVLQSSGLYSLSSVVTVPSSSLGTKTYTCNVDHKPSNTKVDKRVESKYGPPCPPC<br>PAPEAAGGPSVFLFPPKPKDTLMISRTPEVTCVVVDVSQEDPEVQFNWYVDGVEV<br>HNAKTKPREEQFNSTYRVVSVLTVLHQDWLNGKEYKCKVSNKGLPSSIEKTISKAKG<br>QPREPQVYTLPPSQEEMTKNQVSLTCLVKGFYPSDIAVEWESNGQPENNYKTTPPV<br>LDSDGSFFLYSRLTVDKSRWQEGNVFSCSVMHEALHNHYTQKSLSLSLGK<br>QVQLVESGGGVVQPGRSLRLSCAASGFTFSYYGMHWVRQAPGKGLEWVAFISYD<br>GSNKYYADSVKGRFTISRDNSKNTLYLQMNSLRAEDTAVYYCAHLPYSGSYWAFDY<br>WGQGTQVTVSSASTKGPSVFPLAPSSKSTSGGTAALGCLVKDYFPEPVTVSWNSGA<br>LTSGVHTFPAVLQSSGLYSLSSVVTVPSSSLGTQTYICNVNHKPSNTKVDKKVEPKSC |
| KL2B467_HC | 213 | DKTHTCPPCPAPEAAGGPSVFLFPPKPKDTLMISRTPEVTCVVVSVSHEDPEVKFN<br>WYVDGVEVHNAKTKPREEQYNSTYRVVSVLTVLHQDWLNGKEYKCKVSNKALPAP<br>IEKTISKAKGQPREPQVYTLPPSREEMTKNQVSLTCLVKGFYPSDIAVEWESNGQPE<br>NNYKTTPPVLDSDGSFFLYSKLTVDKSRWQQGNVFSCSVMHEALHNHYTQKSLSLS<br>PGK |
| KL2B494_HC | 219 | QVQLVESGGGLVQPGGSLRLSCAASGFTFSHYAMSWVRQAPGKGLEWVSTIGGS<br>GGSTYYADSVKGRFTISRDNSKNTLYLQMNSLRAEDTAVYYCAKPHIVMVTALLYD<br>GMDVWGQGTMVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNTKVDKK<br>VEPKSCDKTHTCPPCPAPEAAGGPSVFLFPPKPKDTLMISRTPEVTCVVVSVSHEDP<br>EVKFNWYVDGVEVHNAKTKPREEQYNSTYRVVSVLTVLHQDWLNGKEYKCKVSNK<br>ALPAPIEKTISKAKGQPREPQVYTLPPSREEMTKNQVSLTCLVKGFYPSDIAVEWESN<br>GQPENNYKTTPPVLDSDGSFFLYSKLTVDKSRWQQGNVFSCSVMHEALHNHYTQK<br>SLSLSPGK |

TABLE 23

Amino acid sequences of the LC (VL-CL) of selected anti-hK2 antibodies in a mAb (Fab-Fc) format.

| KLK2 LIGHT CHAIN | LC PROTEIN SEQ ID NO: | LC AMINO ACID SEQUENCE |
|---|---|---|
| m11B6_LC | 214 | DIVLTQSPASLAVSLGQRATISCRASESVEYFGTSLMHWYRQKPGQPPKLLIYAASN VESGVPARFSGSGSGTDFSLNIQPVEEDDFSMYFCQQTRKVPYTFGGGTKLEIKRAD AAPTVSIFPPSSEQLTSGGASVVCFLNNFYPKDINVKWKIDGSERQNGVLNSWTDQ DSKDSTYSMSSTLTLTKDEYERHNSYTCEATHKTSTSPIVKSFNRNEC |
| h11B6_LC | 215 | DIVLTQSPDSLAVSLGERATINCKASESVEYFGTSLMHWYQQKPGQPPKLLIYAASN RESGVPDRFSGSGSGTDFTLTISSLQAEDVAVYYCQQTRKVPYTFGQGTKLEIKRTVA APSVFIFPPSDEQLKSGTASVVCLLNNFYPREAKVQWKVDNALQSGNSQESVTEQD SKDSTYSLSSTLTLSKADYEKHKVYACEVTHQGLSSPVTKSFNRGEC |
| KL2B30_LC | 221 | DIQMTQSPSFLSASVGDRVTITCRASQGISSYLAWYQQKPGKAPKFLIYAASTLQSG VPSRFSGSGSGTEFTLTISSLQPEDFATYYCQQLNSYPLTFGGGTKVEIKRTVAAPSVF IFPPSDEQLKSGTASVVCLLNNFYPREAKVQWKVDNALQSGNSQESVTEQDSKDST YSLSSTLTLSKADYEKHKVYACEVTHQGLSSPVTKSFNRGEC |
| KL2B53_LC | 222 | DIVMTQSPSSLSASVGDRVTITCRASQDISNYLAWYQQKPGKVPKFLIYAASTLHSG VPSRFSGSGSGTDFTLTISSLQPEDVATYYCQKYNSAPYTFGQGTRLEIKRTVAAPSVF IFPPSDEQLKSGTASVVCLLNNFYPREAKVQWKVDNALQSGNSQESVTEQDSKDST YSLSSTLTLSKADYEKHKVYACEVTHQGLSSPVTKSFNRGEC |
| KL2B242_LC | 223 | SYELTQPPSVSVSPGETASITCSGDQLGENYACWYQQKPGQSPVLVIYQDSKRPSGI PERFSGSNSGNTATLTISGTQALDEADYYCQAWDNSIVVFGGGTKLTVLGQPKAAP SVTLFPPSSEELQANKATLVCLISDFYPGAVTVAWKADSSPVKAGVETTTPSKQSNN KYAASSYLSLTPEQWKSHRSYSCQVTHEGSTVEKTVAPTECS |
| KL2B467_LC | 224 | QSVLTQPPSVSVAPGQTASITCGGDNIGSKSVHWYQQKPGQAPVLVVYDNSDRPS GIPERFSGSNSGTTATLTISRVEAGDEADYYCQVWDSSSDHPVVFGGGTKVTVLGQ PKAAPSVTLFPPSSEELQANKATLVCLISDFYPGAVTVAWKADSSPVKAGVETTTPSK QSNNKYAASSYLSLTPEQWKSHRSYSCQVTHEGSTVEKTVAPTECS |
| KL2B494_LC | 220 | SSELTQPPSVSVAPGQTARITCGGNNIGSKSVHWYQQKPGQAPVLVVYDDSDRPS GIPERFSGSNSGNTATLTISRVEAGDEADYYCQVWDSSSDHVVFGGGTKLTVLGQP KAAPSVTLFPPSSEELQANKATLVCLISDFYPGAVTVAWKADSSPVKAGVETTTPSK QSNNKYAASSYLSLTPEQWKSHRSYSCQVTHEGSTVEKTVAPTECS |

TABLE 24

SEQ ID Nos of the cDNA sequences of HC and LC of selected hK2 antibodies

| Antibody | HC Protein SEQ ID NO: | LC Protein SEQ ID NO: | HC cDNA SEQ ID NO: | LC cDNA SEQ ID NO: |
|---|---|---|---|---|
| m11B6 | 207 | 214 | 248 | 255 |
| hu11B6 | 208 | 215 | 249 | 256 |
| KL2B30 | 210 | 221 | 250 | 257 |
| KL2B53 | 211 | 222 | 251 | 258 |
| KL2B242 | 212 | 223 | 252 | 259 |
| KL2B467 | 213 | 224 | 253 | 260 |
| KL2B494 | 219 | 220 | 254 | 261 |

SEQ ID NO: 248 (m11B6 HC cDNA)
GATGTGCAGCTTCAGGAGTCTGGACCCGGACTTGTTAAACCAAGTCAGTCTCTGTCCCTGAC
CTGTACCGTCACCGGCAACAGCATCACAAGCGATTACGCATGGAACTGGATCAGGCAGTTCC
CTGGAAATCGACTCGAATGGATGGGCTACATTTCATACTCCGGTTCAACCACTTACTCTCCAT
CCTTGAAATCTAGGTTCAGCATCACCCGTGATACCTCAAAGAACCAATTTTTTCTGCAACTG
AATAGCGTAACTCCAGAGGACACAGCCACATATTTCTGCGCCACTGGGTATTACTATGGCTC
AGGTTTCTGGGGTCAGGGCACTCTCGTCACCGTCAGCAGCGCCAAAACAACAGCACCAAGT
GTCTATCCACTGGCCCCTGTGTGTGGAGATACAACTGGCTCCTCGGTGACTCTAGGATGCCT
GGTCAAGGGTTATTTCCCTGAGCCAGTGACCTTGACCTGGAACTCTGGATCCCTGTCCAGTG
GTGTGCACACCTTCCCAGCTGTCCTGCAGTCTGACCTCTACACCCTCAGCAGCTCAGTGACTG
TAACCTCGAGCACCTGGCCCAGCCAGTCCATCACCTGCAATGTGGCCCACCCGGCAAGCAGC
ACCAAGGTGGACAAGAAAATTGAGCCCAGAGGGCCCACAATCAAGCCCTGTCCTCCATGCA

TABLE 24-continued

| SEQ ID Nos of the cDNA sequences of HC and LC of selected hK2 antibodies |
|---|

AATGCCCAGCACCTAACCTCTTGGGTGGACCATCCGTCTTCATCTTCCCTCCAAAGATCAAG
GATGTACTCATGATCTCCCTGAGCCCCATAGTCACATGTGTGGTGGTGGATGTGAGCGAGGA
TGACCCAGATGTCCAGATCAGCTGGTTTGTGAACAACGTGGAAGTACACACAGCTCAGACA
CAAACCCATAGAGAGGATTACAACAGTACTCTCCGGGTGGTCAGTGCCCTCCCCATCCAGCA
CCAGGACTGGATGAGTGGCAAGGAGTTCAAATGCAAGGTCAACAACAAAGACCTCCCAGCG
CCCATCGAGAGAACCATCTCAAAACCCAAAGGGTCAGTAAGAGCTCCACAGGTATATGTCTT
GCCTCCACCAGAAGAAGAGATGACTAAGAAACAGGTCACTCTGACCTGCATGGTCACCGAC
TTCATGCCTGAAGACATTTACGTGGAGTGGACCAACAACGGGAAAACAGAGCTAAACTACA
AGAACACTGAACCAGTCCTGGACTCTGATGGTTCTTACTTCATGTACAGCAAGCTGAGAGTG
GAAAAGAAGAACTGGGTGGAAAGAAATAGCTACTCCTGTTCAGTGGTCCACGAGGGTCTGC
ACAATCACCACACGACTAAGAGCTTCTCCCGGACTCCGGGTAAA

SEQ ID NO: 249 (hu11B6 HC cDNA)
CAGGTCCAACTGCAAGAGAGCGGACCGGGCCTGGTAAAGCCATCCGACACATTGTCCCTGA
CGTGTGCGGTAAGTGGAAACTCTATCACTAGCGACTATGCGTGGAATTGGATAAGACAACC
GCCGGGCAAGGGGCTGGAATGGATAGGATATATCAGCTATTCCGGTTCTACGACATACAATC
CTTCCCTGAAAAGCAGAGTCACTATGTCACGCGACACGTCCAAGAATCAGTTCTCATTGAAA
TTGTCATCCGTAACGGCCGTTGACACTGCGGTTTATTATTGCGCAACCGGATATTACTACGGC
TCTGGTTTTTGGGGACAGGGAACACTTGTTACTGTTAGTTCAGCCTCCACCAAGGGCCCATC
GGTCTTCCCCCTGGCACCCTCCTCCAAGAGCACCTCTGGGGGCACAGCGGCCCTGGGCTGCC
TGGTCAAGGACTACTTCCCCGAACCGGTGACGGTGTCGTGGAACTCAGGCGCCCTGACCAGC
GGCGTGCACACCTTCCCGGCTGTCCTACAGTCCTCAGGACTCTACTCCCTCAGCAGCGTGGT
GACCGTGCCCTCCAGCAGCTTGGGCACCCAGACCTACATCTGCAACGTGAATCACAAGCCCA
GCAACACCAAGGTGGACAAGAAAGTTGAGCCCAAATCTTGTGACAAAACTCACACATGCCC
ACCGTGCCCAGCACCTGAACTCCTGGGGGGACCGTCAGTCTTCCTCTTCCCCCCAAAACCCA
AGGACACCCTCATGATCTCCCGGACCCCTGAGGTCACATGCGTGGTGGTGGACGTGAGCCAC
GAAGACCCTGAGGTCAAGTTCAACTGGTACGTGGACGGCGTGGAGGTGCATAATGCCAAGA
CAAAGCCGCGGGAGGAGCAGTACAACAGCACGTACCGTGTGGTCAGCGTCCTCACCGTCCT
GCACCAGGACTGGCTGAATGGCAAGGAGTACAAGTGCAAGGTCTCCAACAAAGCCCTCCCA
GCCCCCATCGAGAAAACCATCTCCAAAGCCAAAGGGCAGCCCCGAGAACCACAGGTGTACA
CCCTGCCCCCATCCCGGGAGGAGATGACCAAGAACCAGGTCAGCCTGACCTGCCTGGTCAA
AGGCTTCTATCCCAGCGACATCGCCGTGGAGTGGGAGAGCAATGGGCAGCCGGAGAACAAC
TACAAGACCACGCCTCCCGTGCTGGACTCCGACGGCTCCTTCTTCCTCTACAGCAAGCTCAC
CGTGGACAAGAGCAGATGGCAGCAGGGGAACGTCTTCTCATGCTCCGTGATGCATGAGGCT
CTGCACAACCACTACACGCAGAAGAGCCTCTCCCTGTCTCCGGGTAAA

SEQ ID NO: 250 (KL2B30 HC cDNA)
CAGGTGCAGCTGCAGGAGTCGGGCCCAGGACTGGTGAAGCCTTCGGAGACCCTGTCCCTCA
CCTGCACTGTCTCTGGTGGCTCCATCAGTAGTTACTACTGGAGCTGGATCCGGCAGCCCCCA
GGGAAGGGACTGGAGTGGATTGGATATATCTATTACAGTGGGAGCACCAACTACAACCCCT
CCCTCAAGAGTCGAGTCACCATATCAGTAGACACGTCCAAGAACCAGTTCTCCCTGAAGCTG
AGCTCTGTGACCGCTGCGGACACGGCCGTGTATTACTGTGCGGGGACTACGATTTTTGGAGT
GGTTACCCCCAACTTCTACTACGGTATGGACGTCTGGGGCCAAGGGACCACGGTCACCGTCT
CCTCAGCTTCCACCAAGGGCCCATCCGTCTTCCCCCTGGCGCCCTGCTCCAGGAGCACCTCC
GAGAGCACAGCCGCCCTGGGCTGCCTGGTCAAGGACTACTTCCCCGAACCGGTGACGGTGTC
GTGGAACTCAGGCGCCCTGACCAGCGGCGTGCACACCTTCCCGGCTGTCCTACAGTCCTCAG
GACTCTACTCCCTCAGCAGCGTGGTGACCGTGCCCTCCAGCAGCTTGGGCACGAAAACCTAC
ACTTGCAACGTAGATCACAAGCCCAGCAACACCAAGGTGGACAAGAGAGTTGAGTCCAAAT
ATGGTCCCCCATGCCCACCATGCCCAGCACCTGAGGCCGCCGGGGGACCATCAGTCTTCCTG
TTCCCCCCAAAACCCAAGGACACTCTCATGATCTCCCGGACCCCTGAGGTCACGTGCGTGGT
GGTGGACGTGAGCCAGGAAGACCCCGAGGTCCAGTTCAACTGGTACGTGGATGGCGTGGAG
GTGCATAATGCCAAGACAAAGCCGCGGGAGGAGCAGTTCAACAGCACGTACCGTGTGGTCA
GCGTCCTCACCGTCCTGCACCAGGACTGGCTGAACGGCAAGGAGTACAAGTGCAAGGTCTC
CAACAAAGGCCTCCCGTCCTCCATCGAGAAAACCATCTCCAAAGCCAAAGGGCAGCCCCGA
GAGCCACAGGTGTACACCCTGCCCCCATCCCAGGAGGAGATGACCAAGAACCAGGTCAGCC
TGACCTGCCTGGTCAAAGGCTTCTACCCCAGCGACATCGCCGTGGAGTGGGAGAGCAATGG
GCAGCCGGAGAACAACTACAAGACCACGCCTCCCGTGCTGGACTCCGACGGCTCCTTCTTCC
TCTACAGCAGGCTAACCGTGGACAAGAGCAGATGGCAGGAGGGGAATGTCTTCTCATGCTC
CGTGATGCATGAGGCTCTGCACAACCACTACACACAGAAGAGCCTCTCCCTGTCTCTGGGTA
AA

SEQ ID NO: 251 (KL2B53 HC cDNA)
GAGGTGCAGCTGGTGGAGTCTGGGGGAGGCGTGGTCCAGCCTGGGAGGTCCCTGAGACTCT
CCTGTGTAGCCTCTGGATTCACCTTCAGTAGTTATGACATACACTGGGTCCGCCAGGCTCCA
GGCAAGGGGCTGGAGTGGGTGGCAATTATTTCATATGATGGAAGTAAAAAAGACTATACAG
ACTCCGTGAAGGGCCGATTCACCATCTCCAGAGACAATTCCAAGAACACGCTGTATCTGCAA
ATGGACAGCCTGAGAGTTGAGGACTCGGCTGTGTATTCCTGTGCGAGAGAAAGTGGCTGGTC
CCACTACTACTATTACGGTATGGACGTCTGGGGCCAAGGGACAATGGTCACCGTCTCTTCAG
CTTCCACCAAGGGCCCATCCGTCTTCCCCCTGGCGCCCTGCTCCAGGAGCACCTCCGAGAGC
ACAGCCGCCCTGGGCTGCCTGGTCAAGGACTACTTCCCCGAACCGGTGACGGTGTCGTGGAA
CTCAGGCGCCCTGACCAGCGGCGTGCACACCTTCCCGGCTGTCCTACAGTCCTCAGGACTCT
ACTCCCTCAGCAGCGTGGTGACCGTGCCCTCCAGCAGCTTGGGCACGAAAACCTACACTTGC
AACGTAGATCACAAGCCCAGCAACACCAAGGTGGACAAGAGAGTTGAGTCCAAATATGGTC
CCCCATGCCCACCATGCCCAGCACCTGAGGCCGCCGGGGGACCATCAGTCTTCCTGTTCCCC
CCAAAACCCAAGGACACTCTCATGATCTCCCGGACCCCTGAGGTCACGTGCGTGGTGGTGGA
CGTGAGCCAGGAAGACCCCGAGGTCCAGTTCAACTGGTACGTGGATGGCGTGGAGGTGCAT
AATGCCAAGACAAAGCCGCGGGAGGAGCAGTTCAACAGCACGTACCGTGTGGTCAGCGTCC

TABLE 24-continued

SEQ ID Nos of the cDNA sequences of HC and LC of selected hK2 antibodies

TCACCGTCCTGCACCAGGACTGGCTGAACGGCAAGGAGTACAAGTGCAAGGTCTCCAACAA
AGGCCTCCCGTCCTCCATCGAGAAAACCATCTCCAAAGCCAAAGGGCAGCCCCGAGAGCCA
CAGGTGTACACCCTGCCCCCATCCCAGGAGGAGATGACCAAGAACCAGGTCAGCCTGACCT
GCCTGGTCAAAGGCTTCTACCCCAGCGACATCGCCGTGGAGTGGGAGAGCAATGGGCAGCC
GGAGAACAACTACAAGACCACGCCTCCCGTGCTGGACTCCGACGGCTCCTTCTTCCTCTACA
GCAGGCTAACCGTGGACAAGAGCAGATGGCAGGAGGGGAATGTCTTCTCATGCTCCGTGAT
GCATGAGGCTCTGCACAACCACTACACACAGAAGAGCCTCTCCCTGTCTCTGGGTAAA

SEQ ID NO: 252 (KL2B242 HC cDNA)
CAGGTGCAGCTGCAGGAGTCGGGCCCAGGACTGGTGAAGCCTTCGGAGACCCTGTCCCTCA
CCTGCACTGTCTCTGGTGGCTCCATCAGTAGTTACTATTGGAGCTGGCTCCGGCAGCCCGCC
GGGTCGGGACTGGAGTGGATTGGGCGTTTATATGTCAGTGGGTTCACCAACTACAACCCCTC
CCTCAAGAGTCGAGTCACCTTGTCACTAGACCCGTCCAGGAACCAGTTGTCCCTGAAACTGA
GTTCTGTGACCGCCGCGGACACGGCCGTATATTATTGTGCGGGAGATAGTGGGAACTACTGG
GGTTGGTTCGACCCCTGGGGCCAGGGAACCCTGGTCACCGTCTCCTCAGCTTCCACCAAGGG
CCCATCCGTCTTCCCCCTGGCGCCCTGCTCCAGGAGCACCTCCGAGAGCACAGCCGCCCTGG
GCTGCCTGGTCAAGGACTACTTCCCCGAACCGGTGACGGTGTCGTGGAACTCAGGCGCCCTG
ACCAGCGGCGTGCACACCTTCCCGGCTGTCCTACAGTCCTCAGGACTCTACTCCCTCAGCAG
CGTGGTGACCGTGCCCTCCAGCAGCTTGGGCACGAAAACCTACACTTGCAACGTAGATCACA
AGCCCAGCAACACCAAGGTGGACAAGAGAGTTGAGTCCAAATATGGTCCCCCATGCCCACC
ATGCCCAGCACCTGAGGCCGCCGGGGGACCATCAGTCTTCCTGTTCCCCCCAAAACCCAAGG
ACACTCTCATGATCTCCCGGACCCCTGAGGTCACGTGCGTGGTGGTGGACGTGAGCCAGGAA
GACCCCGAGGTCCAGTTCAACTGGTACGTGGATGGCGTGGAGGTGCATAATGCCAAGACAA
AGCCGCGGGAGGAGCAGTTCAACAGCACGTACCGTGTGGTCAGCGTCCTCACCGTCCTGCAC
CAGGACTGGCTGAACGGCAAGGAGTACAAGTGCAAGGTCTCCAACAAAGGCCTCCCGTCCT
CCATCGAGAAAACCATCTCCAAAGCCAAAGGGCAGCCCCGAGAGCCACAGGTGTACACCCT
GCCCCCATCCCAGGAGGAGATGACCAAGAACCAGGTCAGCCTGACCTGCCTGGTCAAAGGC
TTCTACCCCAGCGACATCGCCGTGGAGTGGGAGAGCAATGGGCAGCCGGAGAACAACTACA
AGACCACGCCTCCCGTGCTGGACTCCGACGGCTCCTTCTTCCTCTACAGCAGGCTAACCGTG
GACAAGAGCAGATGGCAGGAGGGGAATGTCTTCTCATGCTCCGTGATGCATGAGGCTCTGC
ACAACCACTACACACAGAAGAGCCTCTCCCTGTCTCTGGGTAAA

SEQ ID NO: 253 (KL2B467 HC cDNA)
CAGGTGCAGCTGGTGGAGTCTGGGGGAGGCGTGGTCCAGCCTGGGAGGTCCCTGAGACTCT
CCTGTGCAGCCTCTGGATTCACCTTCAGTTACTATGGCATGCACTGGGTCCGCCAGGCTCCA
GGCAAGGGGCTGGAGTGGGTGGCATTTATATCATATGATGGAAGTAATAAATACTATGCAG
ACTCCGTGAAGGGCCGATTCACCATCTCCAGAGACAATTCCAAGAACACGCTGTATCTGCAA
ATGAACAGCCTGAGAGCTGAGGACACGGCTGTGTATTACTGTGCCCACCTCCCTTATAGTGG
GAGCTACTGGGCCTTTGACTACTGGGGCCAGGGAACCCAGGTCACCGTCTCTTCAGCCTCCA
CCAAGGGCCCATCGGTCTTCCCCCTGGCACCCTCCTCCAAGAGCACCTCTGGGGGCACAGCG
GCCCTGGGCTGCCTGGTCAAGGACTACTTCCCCGAACCGGTGACGGTGTCGTGGAACTCAGG
CGCCCTGACCAGCGGCGTGCACACCTTCCCGGCTGTCCTACAGTCCTCAGGACTCTACTCCCT
CAGCAGCGTGGTGACCGTGCCCTCCAGCAGCTTGGGCACCCAGACCTACATCTGCAACGTGA
ATCACAAGCCCAGCAACACCAAGGTGGACAAGAAAGTTGAGCCCAAATCTTGTGACAAAAC
TCACACATGCCCACCGTGCCCAGCACCTGAAGCCGCCGGGGGACCGTCAGTCTTCCTCTTCC
CCCCAAAACCCAAGGACACCCTCATGATCTCCCGGACCCCTGAGGTCACATGCGTGGTGGTG
AGCGTGAGCCACGAAGACCCTGAGGTCAAGTTCAACTGGTACGTGGACGGCGTGGAGGTGC
ATAATGCCAAGACAAAGCCGCGGGAGGAGCAGTACAACAGCACGTACCGTGTGGTCAGCGT
CCTCACCGTCCTGCACCAGGACTGGCTGAATGGCAAGGAGTACAAGTGCAAGGTCTCCAAC
AAAGCCCTCCCAGCCCCCATCGAGAAAACCATCTCCAAAGCCAAAGGGCAGCCCCGAGAAC
CACAGGTGTACACCCTGCCCCCATCCCGGGAGGAGATGACCAAGAACCAGGTCAGCCTGAC
CTGCCTGGTCAAAGGCTTCTATCCCAGCGACATCGCCGTGGAGTGGGAGAGCAATGGGCAG
CCGGAGAACAACTACAAGACCACGCCTCCCGTGCTGGACTCCGACGGCTCCTTCTTCCTCTA
CAGCAAGCTCACCGTGGACAAGAGCAGATGGCAGCAGGGGAACGTCTTCTCATGCTCCGTG
ATGCATGAGGCTCTGCACAACCACTACACGCAGAAGAGCCTCTCCCTGTCTCCGGGTAAA

SEQ ID NO: 254 (KL2B494 HC cDNA)
CAGGTGCAGCTGGTGGAGTCTGGGGGAGGCTTGGTACAGCCTGGGGGGTCCCTGAGACTCT
CCTGTGCAGCCTCTGGATTCACCTTTAGTCATTATGCCATGAGCTGGGTCCGCCAGGCTCCAG
GGAAGGGGCTGGAGTGGGTCTCAACTATTGGTGGTAGTGGTGGTAGCACATACTACGCAGA
CTCCGTGAAGGGCCGGTTCACCATCTCCAGAGACAATTCCAAGAACACGCTGTATCTGCAAA
TGAACAGCCTGAGAGCCGAGGACACGGCCGTATATTACTGTGCGAAACCTCATATTGTAATG
GTGACTGCTCTTCTCTACGACGGTATGGACGTCTGGGGCCAAGGGACAATGGTCACCGTCTC
CTCAGCCTCCACCAAGGGCCCATCGGTCTTCCCCCTGGCACCCTCCTCCAAGAGCACCTCTG
GGGGCACAGCGGCCCTGGGCTGCCTGGTCAAGGACTACTTCCCCGAACCGGTGACGGTGTC
GTGGAACTCAGGCGCCCTGACCAGCGGCGTGCACACCTTCCCGGCTGTCCTACAGTCCTCAG
GACTCTACTCCCTCAGCAGCGTGGTGACCGTGCCCTCCAGCAGCTTGGGCACCCAGACCTAC
ATCTGCAACGTGAATCACAAGCCCAGCAACACCAAGGTGGACAAGAAAGTTGAGCCCAAAT
CTTGTGACAAAACTCACACATGCCCACCGTGCCCAGCACCTGAAGCCGCCGGGGGACCGTC
AGTCTTCCTCTTCCCCCCAAAACCCAAGGACACCCTCATGATCTCCCGGACCCCTGAGGTCA
CATGCGTGGTGGTGAGCGTGAGCCACGAAGACCCTGAGGTCAAGTTCAACTGGTACGTGGA
CGGCGTGGAGGTGCATAATGCCAAGACAAAGCCGCGGGAGGAGCAGTACAACAGCACGTA
CCGTGTGGTCAGCGTCCTCACCGTCCTGCACCAGGACTGGCTGAATGGCAAGGAGTACAAGT
GCAAGGTCTCCAACAAAGCCCTCCCAGCCCCCATCGAGAAAACCATCTCCAAAGCCAAAGG
GCAGCCCCGAGAACCACAGGTGTACACCCTGCCCCCATCCCGGGAGGAGATGACCAAGAAC
CAGGTCAGCCTGACCTGCCTGGTCAAAGGCTTCTATCCCAGCGACATCGCCGTGGAGTGGGA
GAGCAATGGGCAGCCGGAGAACAACTACAAGACCACGCCTCCCGTGCTGGACTCCGACGGC

TABLE 24-continued

| SEQ ID Nos of the cDNA sequences of HC and LC of selected hK2 antibodies |
|---|
| TCCTTCTTCCTCTACAGCAAGCTCACCGTGGACAAGAGCAGATGGCAGCAGGGGAACGTCTT<br>CTCATGCTCCGTGATGCATGAGGCTCTGCACAACCACTACACGCAGAAGAGCCTCTCCCTGT<br>CTCCGGGTAAA |
| SEQ ID NO: 255 (mu11B6 LC cDNA)<br>GACATTGTGCTGACACAGAGTCCAGCATCCTTGGCAGTATCTTTGGGGCAGCGGGCAACAAT<br>TTCATGCCGTGCATCTGAAAGTGTGGAGTATTTTGGAACTTCTCTTATGCACTGGTATCGCCA<br>GAAGCCTGGGCAGCCTCCCAAACTCCTTATATATGCCGCTTCCAACGTGGAGTCCGGAGTAC<br>CAGCACGCTTTTCCGGCTCTGGGTCCGGCACAGACTTTTCCCTCAATATCCAACCTGTTGAAG<br>AAGACGATTTTTCCATGTATTTTTGCCAACAGACACGCAAGGTTCCATATACATTCGGCGGC<br>GGCACTAAACTTGAGATCAAACGGGCTGATGCTGCACCGACTGTGTCCATCTTCCCACCATC<br>CAGTGAGCAGTTAACATCTGGAGGTGCCTCAGTCGTGTGCTTCTTGAACAACTTCTACCCCA<br>AAGACATCAATGTCAAGTGGAAGATTGATGGCAGTGAACGACAAAATGGCGTCCTGAACAG<br>TTGGACTGATCAGGACAGCAAAGACAGCACCTACAGCATGAGCAGCACCCTCACGTTGACC<br>AAGGACGAGTATGAACGACATAACAGCTATACCTGTGAGGCCACTCACAAGACATCAACTT<br>CACCCATTGTCAAGAGCTTCAACAGGAATGAGTGT |
| SEQ ID NO: 256 (hu11B6 LC cDNA)<br>GACATAGTCTTGACTCAGAGCCCGGATTCCCTTGCTGTGTCTCTGGGAGAACGAGCTACGAT<br>CAACTGCAAGGCAAGTGAATCCGTAGAATACTTCGGGACATCATTGATGCATTGGTATCAAC<br>AGAAACCGGGGCAACCGCCCAAATTGCTGATATATGCGGCTAGTAATAGAGAATCAGGAGT<br>ACCGGATAGGTTTAGTGGTTCAGGATCAGGTACAGATTTCACCCTGACAATAAGTAGCTTGC<br>AAGCCGAAGACGTAGCAGTGTATTACTGCCAACAAACCCGAAAGGTGCCATATACGTTTGG<br>ACAGGGTACAAAGTTGGAAATCAAACGTACGGTGGCTGCACCATCTGTCTTCATCTTCCCGC<br>CATCTGATGAGCAGTTGAAATCTGGAACTGCCTCTGTTGTGTGCCTGCTGAATAACTTCTATC<br>CCAGAGAGGCCAAAGTACAGTGGAAGGTGGATAACGCCCTCCAATCGGGTAACTCCCAGGA<br>GAGTGTCACAGAGCAGGACAGCAAGGACAGCACCTACAGCCTCAGCAGCACCCTGACGCTG<br>AGCAAAGCAGACTACGAGAAACACAAAGTCTACGCCTGCGAAGTCACCCATCAGGGCCTGA<br>GCTCGCCCGTCACAAAGAGCTTCAACAGGGGAGAGTGT |
| SEQ ID NO: 257 (KL2B30 LC cDNA)<br>GACATCCAGATGACCCAGTCTCCTTCCTTCCTGTCTGCATCTGTAGGAGACAGAGTCACCAT<br>CACTTGCCGGGCCAGTCAGGGCATTAGCAGTTATTTAGCCTGGTATCAGCAAAAACCAGGGA<br>AAGCCCCTAAGTTCCTGATCTATGCTGCATCCACTTTGCAAAGTGGGGTCCCATCAAGGTTC<br>AGCGGCAGTGGATCTGGGACAGAATTCACTCTCACAATCAGCAGCCTGCAGCCTGAAGATTT<br>TGCAACTTATTACTGTCAACAGCTTAATAGTTACCCTCTCACTTTCGGCGGAGGGACCAAGG<br>TGGAAATCAAACGTACGGTGGCTGCACCATCTGTCTTCATCTTCCCGCCATCTGATGAGCAG<br>TTGAAATCTGGAACTGCCTCTGTTGTGTGCCTGCTGAATAACTTCTATCCCAGAGAGGCCAA<br>AGTACAGTGGAAGGTGGATAACGCCCTCCAATCGGGTAACTCCCAGGAGAGTGTCACAGAG<br>CAGGACAGCAAGGACAGCACCTACAGCCTCAGCAGCACCCTGACGCTGAGCAAAGCAGACT<br>ACGAGAAACACAAAGTCTACGCCTGCGAAGTCACCCATCAGGGCCTGAGCTCGCCCGTCAC<br>AAAGAGCTTCAACAGGGGAGAGTGT |
| SEQ ID NO: 258 (KL2B53 LC cDNA)<br>GACATCGTGATGACCCAGTCTCCATCCTCCCTGTCTGCATCTGTAGGAGACAGAGTCACCAT<br>CACTTGCCGGGCGAGTCAGGACATTAGCAATTATTTAGCCTGGTATCAGCAGAAACCAGGG<br>AAAGTTCCTAAGTTCCTGATCTATGCTGCATCCACTTTGCACTCTGGGGTCCCATCTCGGTTC<br>AGTGGCAGTGGATCTGGGACAGATTTCACTCTCACCATCAGCAGCCTGCAGCCTGAAGATGT<br>TGCAACTTATTACTGTCAAAAGTATAACAGTGCCCCGTACACTTTTGGCCAAGGGACACGAC<br>TGGAGATTAAACGTACGGTGGCTGCACCATCTGTCTTCATCTTCCCGCCATCTGATGAGCAG<br>TTGAAATCTGGAACTGCCTCTGTTGTGTGCCTGCTGAATAACTTCTATCCCAGAGAGGCCAA<br>AGTACAGTGGAAGGTGGATAACGCCCTCCAATCGGGTAACTCCCAGGAGAGTGTCACAGAG<br>CAGGACAGCAAGGACAGCACCTACAGCCTCAGCAGCACCCTGACGCTGAGCAAAGCAGACT<br>ACGAGAAACACAAAGTCTACGCCTGCGAAGTCACCCATCAGGGCCTGAGCTCGCCCGTCAC<br>AAAGAGCTTCAACAGGGGAGAGTGT |
| SEQ ID NO: 259 (KL2B242 LC cDNA)<br>TCCTATGAGCTGACTCAGCCACCCTCAGTGTCCGTGTCCCCAGGAGAGACAGCCAGCATCAC<br>CTGCTCTGGAGATCAATTGGGGGAAAATTATGCTTGCTGGTATCAGCAGAAGCCAGGCCAGT<br>CCCCTGTGTTGGTCATCTATCAAGATAGTAAGCGGCCCTCAGGGATCCCTGAGCGATTCTCT<br>GGCTCCAACTCTGGGAACACAGCCACTCTGACCATCAGCGGGACCCAGGCTCTGGATGAGG<br>CTGACTATTACTGTCAGGCGTGGGACAACAGTATTGTGGTATTCGGCGGAGGGACCAAGCTG<br>ACCGTCCTAGGTCAGCCCAAGGCTGCACCCAGTGTCACTCTGTTCCCGCCCTCCTCTGAGGA<br>GCTTCAAGCCAACAAGGCCACACTGGTGTGTCTCATAAGTGACTTCTACCCGGGAGCCGTGA<br>CAGTGGCCTGGAAGGCCGATAGCAGCCCCGTCAAGGCGGGAGTGGAGACCACCACACCCTC<br>CAAACAAAGCAACAACAAGTACGCGGCCAGCAGCTATCTGAGCCTGACGCCTGAGCAGTGG<br>AAGTCCCACAGAAGCTACAGCTGCCAGGTCACGCATGAAGGGAGCACCGTGGAGAAGACAG<br>TGGCCCCTACAGAATGTTCA |
| SEQ ID NO: 260 (KL2B467 LC cDNA)<br>CAGTCTGTGCTGACTCAGCCACCCTCGGTGTCAGTGGCCCCCGGGCAGACGGCCAGTATTAC<br>CTGTGGGGGAGACAACATTGGAAGTAAAAGTGTGCACTGGTACCAGCAGAAGCCAGGCCAG<br>GCCCCTGTGCTGGTCGTCTATGATAATAGCGACCGGCCCTCAGGGATCCCTGAGCGATTCTC<br>TGGCTCCAACTCTGGGACCACGGCCACCCTGACCATCAGCAGGGTCGAAGCCGGGGATGAG<br>GCCGACTATTACTGTCAGGTGTGGGATAGTAGTAGTGATCATCCTGTGGTATTCGGCGGAGG<br>GACCAAGGTCACCGTCCTAGGTCAGCCCAAGGCTGCACCCAGTGTCACTCTGTTCCCGCCCT<br>CCTCTGAGGAGCTTCAAGCCAACAAGGCCACACTGGTGTGTCTCATAAGTGACTTCTACCCG |

TABLE 24-continued

| SEQ ID Nos of the cDNA sequences of HC and LC of selected hK2 antibodies |
|---|
| GGAGCCGTGACAGTGGCCTGGAAGGCCGATAGCAGCCCCGTCAAGGCGGGAGTGGAGACCA<br>CCACACCCTCCAAACAAAGCAACAACAAGTACGCGGCCAGCAGCTATCTGAGCCTGACGCC<br>TGAGCAGTGGAAGTCCCACAGAAGCTACAGCTGCCAGGTCACGCATGAAGGGAGCACCGTG<br>GAGAAGACAGTGGCCCCTACAGAATGTTCA |
| SEQ ID NO: 261 (KL2B494 LC cDNA)<br>TCTTCTGAGCTGACTCAGCCACCCTCGGTGTCAGTGGCCCCAGGACAGACGGCCAGGATTAC<br>CTGTGGGGGAAACAACATTGGAAGTAAAAGTGTGCACTGGTACCAGCAGAAGCCAGGCCAG<br>GCCCCTGTGCTGGTCGTCTATGATGATAGCGACCGGCCCTCAGGGATCCCTGAGCGATTCTC<br>TGGCTCCAACTCTGGGAACACGGCCACCCTGACCATCAGCAGGGTCGAAGCCGGGGATGAG<br>GCCGACTATTACTGTCAGGTGTGGGATAGTAGTAGTGATCATGTGGTATTCGGCGGAGGGAC<br>CAAGCTGACCGTCCTAGGTCAGCCCAAGGCTGCACCCAGTGTCACTCTGTTCCCGCCCTCCT<br>CTGAGGAGCTTCAAGCCAACAAGGCCACACTGGTGTGTCTCATAAGTGACTTCTACCCGGGA<br>GCCGTGACAGTGGCCTGGAAGGCCGATAGCAGCCCCGTCAAGGCGGGAGTGGAGACCACCA<br>CACCCTCCAAACAAAGCAACAACAAGTACGCGGCCAGCAGCTATCTGAGCCTGACGCCTGA<br>GCAGTGGAAGTCCCACAGAAGCTACAGCTGCCAGGTCACGCATGAAGGGAGCACCGTGGAG<br>AAGACAGTGGCCCCTACAGAATGTTCA |

TABLE 25

Amino acid sequences of the variable domain of selected anti-hK2 scFvs antibodies in VH-linker-VL (HL) or in VL-linker-VH (LH) format.

| scFv name | Acronym | Amino acid sequence of scFv | SEQ ID NO: |
|---|---|---|---|
| scFv1 | HCG5_LDC6_HL | QVQLQESGPGLVKPSDTLSLTCAVSGNSITSDYAWNWIRQFPGK<br>GLEWMGYISYSGSTTYNPSLKSRVTISRDTSKNQFSLKLSSVTPVD<br>TAVYYCATGYYYGSGFWGQGTLVTVSSGGSEGKSSGSGSESKST<br>GGSDIVLTQSPDSLAVSLGERATINCKASESVEYFGTSLMHWYQ<br>QKPGQPPKLLIYAASNRESGVPDRFSGSGSGTDFTLTIQSVQAED<br>VSVYFCQQTRKVPYTFGQGTKLEIK | 262 |
| scFv2 | HCG5_hu11B6_HL | QVQLQESGPGLVKPSDTLSLTCAVSGNSITSDYAWNWIRQFPGK<br>GLEWMGYISYSGSTTYNPSLKSRVTISRDTSKNQFSLKLSSVTPVD<br>TAVYYCATGYYYGSGFWGQGTLVTVSSGGSEGKSSGSGSESKST<br>GGSDIVLTQSPDSLAVSLGERATINCKASESVEYFGTSLMHWYQ<br>QKPGQPPKLLIYAASNRESGVPDRFSGSGSGTDFTLTISSLQAEDV<br>AVYYCQQTRKVPYTFGQGTKLEIK | 263 |
| scFv3 | HCF3_hu11B6_HL | QVQLQESGPGLVKPSDTLSLTCAVSGNSITSDYAWNWIRQFPGK<br>GLEWIGYISYSGSTTYNPSLKSRVTISRDTSKNQFSLKLSSVTPVDT<br>AVYYCATGYYYGSGFWGQGTLVTVSSGGSEGKSSGSGSESKSTG<br>GSDIVLTQSPDSLAVSLGERATINCKASESVEYFGTSLMHWYQQ<br>KPGQPPKLLIYAASNRESGVPDRFSGSGSGTDFTLTISSVQAEDV<br>AVYYCQQTRKVPYTFGQGTKLEIK | 264 |
| scFv4 | HCG5_LCB7_HL | QVQLQESGPGLVKPSDTLSLTCAVSGNSITSDYAWNWIRQFPGK<br>GLEWMGYISYSGSTTYNPSLKSRVTISRDTSKNQFSLKLSSVTPVD<br>TAVYYCATGYYYGSGFWGQGTLVTVSSGGSEGKSSGSGSESKST<br>GGSDIVLTQSPDSLAVSLGERATINCKASESVEYFGTSLMHWYQ<br>QKPGQPPKLLIYAASNRESGVPDRFSGSGSGTDFTLTISSVQAED<br>VAVYYCQQTRKVPYTFGQGTKLEIK | 265 |
| scFv5 | LCD6_HCG5_LH | DIVLTQSPDSLAVSLGERATINCKASESVEYFGTSLMHWYQQKP<br>GQPPKLLIYAASNRESGVPDRFSGSGSGTDFTLTIQSVQAEDVSV<br>YFCQQTRKVPYTFGQGTKLEIKGGSEGKSSGSGSESKSTGGSQV<br>QLQESGPGLVKPSDTLSLTCAVSGNSITSDYAWNWIRQFPGKGL<br>EWMGYISYSGSTTYNPSLKSRVTISRDTSKNQFSLKLSSVTPVDTA<br>VYYCATGYYYGSGFWGQGTLVTVSS | 266 |
| scFv6 | hu11B6_HCF3_LH | DIVLTQSPDSLAVSLGERATINCKASESVEYFGTSLMHWYQQKP<br>GQPPKLLIYAASNRESGVPDRFSGSGSGTDFTLTISSLQAEDVAVY<br>YCQQTRKVPYTFGQGTKLEIKGGSEGKSSGSGSESKSTGGSQVQ<br>LQESGPGLVKPSDTLSLTCAVSGNSITSDYAWNWIRQFPGKGLE<br>WIGYISYSGSTTYNPSLKSRVTISRDTSKNQFSLKLSSVTPVDTAVY<br>YCATGYYYGSGFWGQGTLVTVSS | 267 |
| scFv7 | hu11B6_HCG5_LH | DIVLTQSPDSLAVSLGERATINCKASESVEYFGTSLMHWYQQKP<br>GQPPKLLIYAASNRESGVPDRFSGSGSGTDFTLTISSLQAEDVAVY<br>YCQQTRKVPYTFGQGTKLEIKGGSEGKSSGSGSESKSTGGSQVQ<br>LQESGPGLVKPSDTLSLTCAVSGNSITSDYAWNWIRQFPGKGLE | 268 |

TABLE 25-continued

Amino acid sequences of the variable domain of selected anti-hK2 scFvs antibodies in VH-linker-VL (HL) or in VL-linker-VH (LH) format.

| scFv name | Acronym | Amino acid sequence of scFv | SEQ ID NO: |
|---|---|---|---|
| | | WMGYISYSGSTTYNPSLKSRVTISRDTSKNQFSLKLSSVTPVDTAV YYCATGYYYGSGFWGQGTLVTVSS | |
| scFv8 | LCB7_HCF3_LH | DIVLTQSPDSLAVSLGERATINCKASESVEYFGTSLMHWYQQKP GQPPKLLIYAASNRESGVPDRFSGSGSGTDFTLTISSVQAEDVAV YYCQQTRKVPYTFGQGTKLEIKGGSEGKSSGSGSESKSTGGSQV QLQESGPGLVKPSDTLSLTCAVSGNSITSDYAWNWIRQFPGKGL EWIGYISYSGSTTYNPSLKSRVTISRDTSKNQFSLKLSSVTPVDTAV YYCATGYYYGSGFWGQGTLVTVSS | 269 |
| scFv9 | LCB7_HCG5_LH | DIVLTQSPDSLAVSLGERATINCKASESVEYFGTSLMHWYQQKP GQPPKLLIYAASNRESGVPDRFSGSGSGTDFTLTISSVQAEDVAV YYCQQTRKVPYTFGQGTKLEIKGGSEGKSSGSGSESKSTGGSQV QLQESGPGLVKPSDTLSLTCAVSGNSITSDYAWNWIRQFPGKGL EWMGYISYSGSTTYNPSLKSRVTISRDTSKNQFSLKLSSVTPVDTA VYYCATGYYYGSGFWGQGTLVTVSS | 270 |
| scFv10 | LCD6_HCF3_LH | DIVLTQSPDSLAVSLGERATINCKASESVEYFGTSLMHWYQQKP GQPPKLLIYAASNRESGVPDRFSGSGSGTDFTLTIQSVQAEDVSV YFCQQTRKVPYTFGQGTKLEIKGGSEGKSSGSGSESKSTGGSQV QLQESGPGLVKPSDTLSLTCAVSGNSITSDYAWNWIRQFPGKGL EWIGYISYSGSTTYNPSLKSRVTISRDTSKNQFSLKLSSVTPVDTAV YYCATGYYYGSGFWGQGTLVTVSS | 271 |
| scFv11 | hu11B6_LCB7_HL | QVQLQESGPGLVKPSDTLSLTCAVSGNSITSDYAWNWIRQPPGK GLEWIGYISYSGSTTYNPSLKSRVTMSRDTSKNQFSLKLSSVTAVD TAVYYCATGYYYGSGFWGQGTLVTVSSGGSEGKSSGSGSESKST GGSDIVLTQSPDSLAVSLGERATINCKASESVEYFGTSLMHWYQ QKPGQPPKLLIYAASNRESGVPDRFSGSGSGTDFTLTISSVQAED VAVYYCQQTRKVPYTFGQGTKLEIK | 272 |
| scFv12 | hu11B6_LCD6_HL | QVQLQESGPGLVKPSDTLSLTCAVSGNSITSDYAWNWIRQPPGK GLEWIGYISYSGSTTYNPSLKSRVTMSRDTSKNQFSLKLSSVTAVD TAVYYCATGYYYGSGFWGQGTLVTVSSGGSEGKSSGSGSESKST GGSDIVLTQSPDSLAVSLGERATINCKASESVEYFGTSLMHWYQ QKPGQPPKLLIYAASNRESGVPDRFSGSGSGTDFTLTIQSVQAED VSVYFCQQTRKVPYTFGQGTKLEIK | 273 |
| scFv13 | hu11B6_HL | QVQLQESGPGLVKPSDTLSLTCAVSGNSITSDYAWNWIRQPPGK GLEWIGYISYSGSTTYNPSLKSRVTMSRDTSKNQFSLKLSSVTAVD TAVYYCATGYYYGSGFWGQGTLVTVSSGGSEGKSSGSGSESKST GGSDIVLTQSPDSLAVSLGERATINCKASESVEYFGTSLMHWYQ QKPGQPPKLLIYAASNRESGVPDRFSGSGSGTDFTLTISSLQAEDV AVYYCQQTRKVPYTFGQGTKLEIK | 274 |
| scFv14 | LCD6_hu11B6_LH | DIVLTQSPDSLAVSLGERATINCKASESVEYFGTSLMHWYQQKP GQPPKLLIYAASNRESGVPDRFSGSGSGTDFTLTIQSVQAEDVSV YFCQQTRKVPYTFGQGTKLEIKGGSEGKSSGSGSESKSTGGSQV QLQESGPGLVKPSDTLSLTCAVSGNSITSDYAWNWIRQPPGKGL EWIGYISYSGSTTYNPSLKSRVTMSRDTSKNQFSLKLSSVTAVDTA VYYCATGYYYGSGFWGQGTLVTVSS | 275 |
| scFv15 | hu11B6_LH | DIVLTQSPDSLAVSLGERATINCKASESVEYFGTSLMHWYQQKP GQPPKLLIYAASNRESGVPDRFSGSGSGTDFTLTISSLQAEDVAVY YCQQTRKVPYTFGQGTKLEIKGGSEGKSSGSGSESKSTGGSQVQ LQESGPGLVKPSDTLSLTCAVSGNSITSDYAWNWIRQPPGKGLE WIGYISYSGSTTYNPSLKSRVTMSRDTSKNQFSLKLSSVTAVDTA VYYCATGYYYGSGFWGQGTLVTVSS | 276 |
| scFv16 | LCB7_hu11B6_LH | DIVLTQSPDSLAVSLGERATINCKASESVEYFGTSLMHWYQQKP GQPPKLLIYAASNRESGVPDRFSGSGSGTDFTLTISSVQAEDVAV YYCQQTRKVPYTFGQGTKLEIKGGSEGKSSGSGSESKSTGGSQV QLQESGPGLVKPSDTLSLTCAVSGNSITSDYAWNWIRQPPGKGL EWIGYISYSGSTTYNPSLKSRVTMSRDTSKNQFSLKLSSVTAVDTA VYYCATGYYYGSGFWGQGTLVTVSS | 277 |
| scFv17 | KL2B413_HL | EVQLVESGGGLVQPGGSLRLSCAASGFTFSSYWMTWVRQAPG KGLEWVANIKQDGSERYYVDSVKGRFTISRDNAKNSLYLQMNSL RAEDTAVYYCARDQNYDILTGHYGMDVWGQGTTVTVSSGGSE GKSSGSGSESKSTGGSEIVLTQSPSFLSASVGDRVTITCRASQGISS YLSWYQQKPGKAPKLLIYATSTLQSGVPSRFSGSGSGTEFTLTISSL QPEDFATYYCQQLNSYPRTFGQGTKVEIK | 278 |

TABLE 25-continued

Amino acid sequences of the variable domain of selected anti-hK2 scFvs antibodies in VH-linker-VL (HL) or in VL-linker-VH (LH) format.

| scFv name | Acronym | Amino acid sequence of scFv | SEQ ID NO: |
|---|---|---|---|
| scFv18 | KL2B413_LH | EIVLTQSPSFLSASVGDRVTITCRASQGISSYLSWYQQKPGKAPKL LIYATSTLQSGVPSRFSGSGSGTEFTLTISSLQPEDFATYYCQQLNS YPRTFGQGTKVEIKGGSEGKSSGSGSESKSTGGSEVQLVESGGGL VQPGGSLRLSCAASGFTFSSYWMTWVRQAPGKGLEWVANIKQ DGSERYYVDSVKGRFTISRDNAKNSLYLQMNSLRAEDTAVYYCA RDQNYDILTGHYGMDVWGQGTTVTVSS | 279 |
| scFv19 | KL2B359_HL | QVQLQESGPGLVKPSQTLSLTCTVSGNSITSDYAWNWIRQFPGK RLEWIGYISYSGSTTYNPSLKSRVTISRDTSKNQFSLKLSSVTAADT AVYYCATGYYYGSGFWGQGTLVTVSSGGSEGKSSGSGSESKSTG GSEIVLTQSPATLSLSPGERATLSCRASESVEYFGTSLMHWYQQK PGQPPRLLIYAASNVESGIPARFSGSGSGTDFTLTISSVEPEDFAVY FCQQTRKVPYTFGGGTKVEIK | 280 |
| scFv20 | KL2B359_LH | EIVLTQSPATLSLSPGERATLSCRASESVEYFGTSLMHWYQQKPG QPPRLLIYAASNVESGIPARFSGSGSGTDFTLTISSVEPEDFAVYFC QQTRKVPYTFGGGTKVEIKGGSEGKSSGSGSESKSTGGSQVQLQ ESGPGLVKPSQTLSLTCTVSGNSITSDYAWNWIRQFPGKRLEWI GYISYSGSTTYNPSLKSRVTISRDTSKNQFSLKLSSVTAADTAVYYC ATGYYYGSGFWGQGTLVTVSS | 281 |
| scFv21 | KL2B357_HL | QVQLQESGPGLVKPSQTLSLTCTVSGNSITSDYAWNWIRQFPGK GLEWIGYISYSGSTTYNPSLKSRVTISRDTSKNQFSLKLSSVTAADT AVYYCATGYYYGSGFWGQGTLVTVSSGGSEGKSSGSGSESKSTG GSDIVLTQSPDSLAVSLGERATINCRASESVEYFGTSLMHWYQQ KPGQPPKLLIYAASNVESGVPDRFSGSGSGTDFTLTISSLQAEDVA VYFCQQTRKVPYTFGGGTKVEIK | 282 |
| scFv22 | KL2B357_LH | DIVLTQSPDSLAVSLGERATINCRASESVEYFGTSLMHWYQQKP GQPPKLLIYAASNVESGVPDRFSGSGSGTDFTLTISSLQAEDVAVY FCQQTRKVPYTFGGGTKVEIKGGSEGKSSGSGSESKSTGGSQVQ LQESGPGLVKPSQTLSLTCTVSGNSITSDYAWNWIRQFPGKGLE WIGYISYSGSTTYNPSLKSRVTISRDTSKNQFSLKLSSVTAADTAVY YCATGYYYGSGFWGQGTLVTVSS | 283 |
| scFv23 | KL2B358_HL | QVQLQESGPGLVKPSQTLSLTCTVSGNSITSDYAWNWIRQPPGK GLEWIGYISYSGSTTYNPSLKSRVTISRDTSKNQFSLKLSSVTAADT AVYYCATGYYYGSGFWGQGTLVTVSSGGSEGKSSGSGSESKSTG GSEIVLTQSPATLSLSPGERATLSCRASESVEYFGTSLMHWYQQK PGQPPRLLIYAASNVESGIPARFSGSGSGTDFTLTISSVEPEDFAVY FCQQTRKVPYTFGGGTKVEIK | 284 |
| scFv24 | KL2B358_LH | EIVLTQSPATLSLSPGERATLSCRASESVEYFGTSLMHWYQQKPG QPPRLLIYAASNVESGIPARFSGSGSGTDFTLTISSVEPEDFAVYFC QQTRKVPYTFGGGTKVEIKGGSEGKSSGSGSESKSTGGSQVQLQ ESGPGLVKPSQTLSLTCTVSGNSITSDYAWNWIRQPPGKGLEWI GYISYSGSTTYNPSLKSRVTISRDTSKNQFSLKLSSVTAADTAVYYC ATGYYYGSGFWGQGTLVTVSS | 285 |
| scFv25 | KL2B360_HL | QVQLQESGPGLVKPSQTLSLTCTVSGNSITSDYAWNWIRQFPGK GLEWIGYISYSGSTTYNPSLKSRVTISRDTSKNQFSLKLSSVTAADT AVYYCATGYYYGSGFWGQGTLVTVSSGGSEGKSSGSGSESKSTG GSEIVLTQSPATLSLSPGERATLSCRASESVEYFGTSLMHWYQQK PGQPPRLLIYAASNVESGIPARFSGSGSGTDFTLTISSVEPEDFAVY FCQQTRKVPYTFGGGTKVEIK | 286 |
| scFv26 | KL2B360_LH | EIVLTQSPATLSLSPGERATLSCRASESVEYFGTSLMHWYQQKPG QPPRLLIYAASNVESGIPARFSGSGSGTDFTLTISSVEPEDFAVYFC QQTRKVPYTFGGGTKVEIKGGSEGKSSGSGSESKSTGGSQVQLQ ESGPGLVKPSQTLSLTCTVSGNSITSDYAWNWIRQFPGKGLEWI GYISYSGSTTYNPSLKSRVTISRDTSKNQFSLKLSSVTAADTAVYYC ATGYYYGSGFWGQGTLVTVSS | 287 |
| scFv27 | KL2B467_HL | QVQLVESGGGVVQPGRSLRLSCAASGFTFSYYGMHWVRQAPG KGLEWVAFISYDGSNKYYADSVKGRFTISRDNSKNTLYLQMNSL RAEDTAVYYCAHLPYSGSYWAFDYWGQGTQVTVSSGGSEGKSS GSGSESKSTGGSQSVLTQPPSVSVAPGQTASITCGGDNIGSKSVH WYQQKPGQAPVLVVYDNSDRPSGIPERFSGSNSGTTATLTISRV EAGDEADYYCQVWDSSSDHPVVFGGGTKVTV | 288 |
| scfv28 | KL2B467_LH | QSVLTQPPSVSVAPGQTASITCGGDNIGSKSVHWYQQKPGQAP VLVVYDNSDRPSGIPERFSGSNSGTTATLTISRVEAGDEADYYCQ VWDSSSDHPVVFGGGTKVTVGGSEGKSSGSGSESKSTGGSQVQ LVESGGGVVQPGRSLRLSCAASGFTFSYYGMHWVRQAPGKGLE | 289 |

TABLE 25-continued

Amino acid sequences of the variable domain of selected anti-hK2 scFvs antibodies in VH-linker-VL (HL) or in VL-linker-VH (LH) format.

| scFv name | Acronym | Amino acid sequence of scFv | SEQ ID NO: |
|---|---|---|---|
| | | WVAFISYDGSNKYYADSVKGRFTISRDNSKNTLYLQMNSLRAED TAVYYCAHLPYSGSYWAFDYWGQGTQVTVSS | |
| scFv39 | KL2B494_HL | QVQLVESGGGLVQPGGSLRLSCAASGFTFSHYAMSWVRQAPG KGLEWVSTIGGSGGSTYYADSVKGRFTISRDNSKNTLYLQMNSL RAEDTAVYYCAKPHIVMVTALLYDGMDVWGQGTMVTVSS GGSEGKSSGSGSESKSTGGSSSELTQPPSVSVAPGQTARITCGGN NIGSKSVHWYQQKPGQAPVLVVYDDSDRPSGIPERFSGSNSGN TATLTISRVEAGDEADYYCQVWDSSSDHVVFGGGTKLTVL | 290 |
| scFv40 | KL2B494_LH | SSELTQPPSVSVAPGQTARITCGGNNIGSKSVHWYQQKPGQAP VLVVYDDSDRPSGIPERFSGSNSGNTATLTISRVEAGDEADYYCQ VWDSSSDHVVFGGGTKLTVLGGSEGKSSGSGSESKSTGGSQVQ LVESGGGLVQPGGSLRLSCAASGFTFSHYAMSWVRQAPGKGLE WVSTIGGSGGSTYYADSVKGRFTISRDNSKNTLYLQMNSLRAED TAVYYCAKPHIVMVTALLYDGMDVWGQGTMVTVSS | 291 |
| scFv41 | KL2B30_HL | QVQLQESGPGLVKPSETLSLTCTVSGGSISSYYWSWI RQPPGKGLEWIGYIYYSGSTNYNPSLKSRVTISVDTS KNQFSLKLSSVTAADTAVYYCAGTTIFGVVTPNFYY GMDVWGQGTTVTVSSGGSEGKSSGSGSESKSTGGS DIQMTQSPSFLSASVGDRVTITCRASQGISSYLAWYQ QKPGKAPKFLIYAASTLQSGVPSRFSGSGSGTEFTLTI SSLQPEDFATYYCQQLNSYPLTFGGGTKVEIK | 365 |
| scFv42 | KL2B30_LH | DIQMTQSPSFLSASVGDRVTITCRASQGISSYLAWYQ QKPGKAPKFLIYAASTLQSGVPSRFSGSGSGTEFTLTI SSLQPEDFATYYCQQLNSYPLTFGGGTKVEIKGGSEG KSSGSGSESKSTGGSQVQLQESGPGLVKPSETLSLTC TVSGGSISSYYWSWIRQPPGKGLEWIGYIYYSGSTNY NPSLKSRVTISVDTSKNQFSLKLSSVTAADTAVYYCA GTTIFGVVTPNFYYGMDVWGQGTTVTVSS | 366 |
| scFv43 | KL2B53_HL | EVQLVESGGGVVQPGRSLRLSCVASGFTFSSYDIHW VRQAPGKGLEWVAIISYDGSKKDYTDSVKGRFTISR DNSKNTLYLQMDSLRVEDSAVYSCARESGWSHYYY YGMDVWGQGTMVTVSSGGSEGKSSGSGSESKSTGG SDIVMTQSPSSLSASVGDRVTITCRASQDISNYLAWY QQKPGKVPKFLIYAASTLHSGVPSRFSGSGSGTDFTL TISSLQPEDVATYYCQKYNSAPYTFGQGTRLEIK | 367 |
| scFv44 | KL2B53_LH | DIVMTQSPSSLSASVGDRVTITCRASQDISNYLAWYQ QKPGKVPKFLIYAASTLHSGVPSRFSGSGSGTDFTLTI SSLQPEDVATYYCQKYNSAPYTFGQGTRLEIKGGSE GKSSGSGSESKSTGGSEVQLVESGGGVVQPGRSLRL SCVASGFTFSSYDIHWVRQAPGKGLEWVAIISYDGS KKDYTDSVKGRFTISRDNSKNTLYLQMDSLRVEDSA VYSCARESGWSHYYYYGMDVWGQGTMVTVSS | 368 |
| scFv45 | KL2B242_HL | QVQLQESGPGLVKPSETLSLTCTVSGGSISSYYWSWL RQPAGSGLEWIGRLYVSGFTNYNPSLKSRVTLSLDPS RNQLSLKLSSVTAADTAVYYCAGDSGNYWGWFDP WGQGTLVTVSSGGSEGKSSGSGSESKSTGGSSYELT QPPSVSVSPGETASITCSGDQLGENYACWYQQKPGQ SPVLVIYQDSKRPSGIPERFSGSNSGNTATLTISGTQA LDEADYYCQAWDNSIVVFGGGTKLTVL | 369 |
| scFv46 | KL2B242_LH | SYELTQPPSVSVSPGETASITCSGDQLGENYACWYQ QKPGQSPVLVIYQDSKRPSGIPERFSGSNSGNTATLTI SGTQALDEADYYCQAWDNSIVVFGGGTKLTVLGGS EGKSSGSGSESKSTGGSQVQLQESGPGLVKPSETLSL TCTVSGGSISSYYWSWLRQPAGSGLEWIGRLYVSGF TNYNPSLKSRVTLSLDPSRNQLSLKLSSVTAADTAV YYCAGDSGNYWGWFDPWGQGTLVTVSS | 370 |

Biophysical Characterization of Anti-hK2 Antibodies

Affinity and Thermal Stability of Anti-hK2 Antibodies.

Affinity of selected hK2 antibodies for soluble hK2 was measured by surface plasmon resonance (SPR). SPR is a label-free technique to study the strength of an interaction between two binding partners by measuring the change in mass upon complex formation and dissociation. Antibodies were captured on a sensor chip coated with an anti-Fc antibody followed by injection of soluble hK2 at various concentrations and specified association and dissociation times. Post dissociation, the surface was regenerated with an appropriate solution to prepare for the next interaction. Kinetic information (on-rate and off-rate constants) were extracted by fitting sensorgrams to the 1:1 Langmuir model. Binding affinity ($K_D$) are reported as the ratio of rate constants ($k_{off}/k_{on}$). $K_D$ values of selected hK2 antibodies are listed in Table 26.

Thermal stability was determined by Differential Scanning Fluorimetry (NanoDSF) using an automated Prometheus instrument. NanoDSF was used to measure $T_m$ of molecules at a concentration of 0.5 mg/mL in Phosphate Buffered Saline, pH 7.4. Measurements were made by loading samples into 24 well capillary from a 384 well sample plate. Duplicate runs were performed for each sample. The thermal scans span from 20° C. to 95° C. at a rate of 1.0° C./minute. Intrinsic tryptophan and tyrosine fluorescence were monitored at the emission wavelengths of 330 nm and 350 nm, and the F350/F330 nm ratio were plotted against temperature to generate unfolding curves. Measured Tm values are listed in Table 26.

TABLE 26

$K_D$ and Tm of selected molecules

| Molecule | $K_D$ (nM) | Tm (° C.) |
|---|---|---|
| KL2B413 (scFv-LH-Fc) | 34.3 | 67 |
| KL2B359 (scFv-LH-Fc) | 0.7-1 | 67 |
| KL2B30 (Fab) | 0.460 | >70 |
| KL2B242 (Fab) | 0.040 | >70 |
| KL2B53 (Fab) | 0.080 | >70 |
| KL2B467 (Fab) | 0.078 | >70 |
| KL2B494 (Fab) | 0.053 | >70 |

KL2B413 scFv generated from the Ablexis® immunization campaign had a thermal stability (Tm) of 67° C. as measured by Nano DSF and a binding affinity (KD) to human hK2 of about 34 nM. Clone KL2B359 obtained for the re-humanization campaign and which had maintained binding affinity similar to murine 11B6 was converted to sfFv-Fc and CAR-T for additional profiling. KL2B359 scFv shows a Tm of 67° C. and a binding affinity (KD) to hK2 of ~0.7-1 nM. KL2B30, KL2B242, KL2B53, KL2B467 and KL2B494 Fab showed binding affinities below 0.5 nM and Tm values above 70° C.

Epitope and Paratope Mapping

The epitope and paratope of selected anti-hK2 antibodies was determined by hydrogen-deuterium exchange mass spectrometry (HDX-MS). Human KLK2 antigen was used for epitope and paratope mapping experiment.

Briefly, purified the KLK2 antigen was incubated with and without anti-hK2 antibodies in deuterium oxide labeling buffer. The hydrogen-deuterium exchange (HDX) mixture was quenched at different time point by the addition of 8 M urea, 1M TCEP, pH 3.0. The quenched sample was passed over an immobilized pepsin/FPXIII column at 600 μL/min equilibrated with buffer A (1% acetonitrile, 0.1% FA in H2O) at room temperature. Peptic fragments were loaded onto a reverse phase trap column at 600 μL/min with buffer A and desalted for 1 min (600 μL buffer A). The desalted fragments were separated by a C18 column with a linear gradient of 8% to 35% buffer B (95% acetonitrile, 5% H2O, 0.0025% TFA) at 100 μL/min over 20 min and analyzed by mass spectrometry. Mass spectrometric analyses were carried out using an LTQ™ Orbitrap Fusion Lumos mass spectrometer (Thermo Fisher Scientific) with the capillary temperature at 275° C., resolution 150,000, and mass range (m/z) 300-1,800. BioPharma Finder 3.0 (Thermo Fisher Scientific) was used for the peptide identification of non-deuterated samples prior to the HDX experiments. HDExaminer version 2.5 (Sierra Analytics, Modesto, CA) was used to extract centroid values from the MS raw data files for the HDX experiments.

Incubation of hK2 antibodies, hu11B6, KL2B494, KL2B467, KL2B30, KL2B413 and KL2B53 with soluble hK2 protein resulted in different patterns of hydrogen exchange and overall protection. The protected segments were mapped onto the sequence of hK2 antigen to visualize the binding epitopes (FIG. 7). KL2B494, KL2B467 and KL2B30 bound to common sequences of (i) residues 173-178 (SEQ ID NO: 209, KVTEF) (e.g., KL2B494, KL2B467 and KL2B30 bound at least three of the residues of SEQ ID NO: 209, namely, the KVT residues at 173-175) and (ii) residue 230-234 (SEQ ID NO: 216, HYRKW) (e.g., KL2B494, KL2B467 and KL2B30 bound at least three of the residues of SEQ ID NO: 216, namely, the HYR residues at 230-232). KL2B413 also bound all residues of SEQ ID NO: 209 and the KW residues of SEQ ID NO: 216, as shown in FIG. 7. An embodiment of the present invention provides an isolated protein comprising an antigen binding domain that binds hK2, wherein said antigen binding domain binds to hK2 within epitopes having sequences of SEQ ID NO: 209 and SEQ ID NO: 216; for example, said antigen binding domain binds to all residues, or at least four residues, or at least three residues of SEQ ID NO: 209 and binds to all residues, or at least four residues, or at least three residues of SEQ ID NO: 216.

KL2B53 showed a different pattern of protection and bound to a sequence consisting of residues 27-32 (Seq ID NO: 217, SHGWAH), 60-75 (SEQ ID NO: 218, RHNLFEPEDTGQRVP) and 138-147 (SEQ ID NO: 292, GWGSIEPEE).

According to an embodiment, an isolated anti-hK2/anti-CD3 protein (e.g., hu11B6, KL2B494, KL2B467, KL2B30, KL2B413, or KL2B53) comprises an hk2-specific antigen binding domain that specifically binds to a discontinuous epitope (i.e., epitopes whose residues are distantly placed in the sequence) of hK2 comprising one or more amino acid sequences selected from the group consisting of SEQ ID NO: 209, 216, 217, 218, and 292.

The paratope of anti-hK2 antibodies hu11B6, KL2B494, KL2B467, KL2B413 and anti-hK2/CD3 bispecific antibodies KLCB113 and KLCB80 were identified based on significant differences in deuterium uptake from the HDExaminer residue plots. KL2BB494 comprises three paratope regions two of which are located in the KL2B494 heavy chain variable domain (GFTFSH (SEQ ID NO: 729) and TAVYYCAKPHIVMVTAL (SEQ ID NO: 730)) and a single paratope region located within the light chain variable domain (YDDSDRPSGIPER (SEQ ID NO: 731)). KL2B467 comprises three paratope regions, two of which are located in the KL2B467 heavy chain variable domain (FTFSY (SEQ ID NO: 732) and GSYWAFDY (SEQ ID NO: 733)) and a single paratope region within the light chain variable domain (DNSD (SEQ ID NO: 734)). Hu11B6 comprises a single epitope region located in the heavy chain (GNSITSDYA (SEQ ID NO: 735)). KL2B413 comprises two paratope regions located in the heavy chain variable domain (GFTF (SEQ ID NO: 736) and ARDQNYDIL (SEQ ID NO: 737)). KL2B30 of bispecific KLCB80 comprise a paratope region locate in the heavy chain (comprising amino acid residues TIF and VTPNF (SEQ ID NO: 738)) and a paratope region located in the light chain (YAASTLQSG (SEQ ID NO: 739)). KL2B53 of bispecific KLCB113 comprise a single paratope region locate in the heavy chain (comprising amino acid residues ESGWSHY (SEQ ID NO: 740)). FIG. 11 (11A-11F) show the binding paratope of these anti-hK2 antibodies and anti-hK2/CD3 bispecific antibodies (underlined sequences indicate CDR regions and highlighted sequences indicate paratope regions).

Example 3. Generation of Bi-Specific Anti-hK2×Anti-CD3 Antibodies

The VH/VL regions of the anti-hK2 antibodies generated in Example 2 and the VH/VL regions of the anti-CD3 antibodies generated in Example 1 were engineered into bispecific format and expressed as IgG1.

Engineering of CD3 scFvs for hK2/CD3 Bispecific Generation

CD3 VH/VL regions were engineered as scFvs in either VH-Linker-VL or VL-linker-VH orientations using the linker of SEQ ID NO: 31 (Table 27). The VH-Linker-VL or VL-linker-VH scFv molecules binding CD3 were further engineered into a scFv-hinge-CH2-CH3 (also called scFv-Fc) format comprising Fc silencing mutation (L234A/L235A/D265S) and the T350V/L351Y/F405A/Y407V mutations designed to promote selective heterodimerization (Table 28). The polypeptide of SEQ ID NO: 293 was used as the constant domain hinge-CH2-CH3. The scFv-hinge-CH2-CH3 proteins binding CD3 were engineered either having or lacking the C-terminal Lysin in the CH3 domain (Table 28). DNA sequences of anti-CD3 molecules in scFv format and scFv-hinge-CH2-CH3 format are shown in Table 29.

(huIgG1_G1m(17)-hinge-Fc_C220S_AAS_ZWA)

SEQ ID NO: 293

EPKSSDKTHTCPPCPAPEAAGGPSVFLFPPKPKDTLMISRTPEVTCVVVSV

SHEDPEVKFNWYVDGVEVHNAKTKPREEQYNSTYRVVSVLTVLHQDWLNGK

EYKCKVSNKALPAPIEKTISKAKGQPREPQVYVYPPSREEMTKNQVSLTCL

VKGFYPSDIAVEWESNGQPENNYKTTPPVLDSDGSFALVSKLTVDKSRWQQ

GNVFSCSVMHEALHNHYTQKSLSLSPG

TABLE 27

CD3 specific scFvs sequences.

| Acronym | Amino acid sequence | SEQ ID NO: |
|---|---|---|
| CD3W244_HL | EVQLVESGGGLVKPGGSLRLSCAASGFTFSRYNMNWVRQAPGKGLEWVS<br>SISTSSNYIYYADSVKGRFTFSRDNAKNSLDLQMSGLRAEDTAIYYCTRGWG<br>PFDYWGQGTLVTVSSGGSEGKSSGSGSESKSTGGSDIQMTQSPSSLSASVG<br>DRVTITCRARQSIGTAIHWYQQKPGKAPKLLIYYASESISGVPSRFSGSGSGT<br>DFTLTISSVQPEDFATYYCQQSGSWPYTFGQGTKLEIK | 65 |
| CD3W244_LH | DIQMTQSPSSLSASVGDRVTITCRARQSIGTAIHWYQQKPGKAPKLLIYYAS<br>ESISGVPSRFSGSGSGTDFTLTISSVQPEDFATYYCQQSGSWPYTFGQGTKL<br>EIKGGSEGKSSGSGSESKSTGGSEVQLVESGGGLVKPGGSLRLSCAASGFTF<br>SRYNMNWVRQAPGKGLEWVSSISTSSNYIYYADSVKGRFTFSRDNAKNSL<br>DLQMSGLRAEDTAIYYCTRGWGPFDYWGQGTLVTVSS | 66 |
| CD3W245_HL | EVQLVESGGGLVKPGGSLRLSCAASGFTFSRYNMNWVRQAPGKGLEWVS<br>SISTSSNYIYYADSVKGRFTFSRDNAKNSLDLQMSGLRAEDTAIYYCTRGWG<br>PFDYWGQGTLVTVSSGGSEGKSSGSGSESKSTGGSDIQMTQSPSSLSASVG<br>DRVTITCRARQSIGTAIHWYQQKPGKAPKLLIKYASESISGVPSRFSGSGSGT<br>DFTLTISSLQPEDFATYYCQQSGSWPYTFGQGTKLEIK | 67 |
| CD3W245_LH | DIQMTQSPSSLSASVGDRVTITCRARQSIGTAIHWYQQKPGKAPKLLIKYAS<br>ESISGVPSRFSGSGSGTDFTLTISSLQPEDFATYYCQQSGSWPYTFGQGTKLE<br>IKGGSEGKSSGSGSESKSTGGSEVQLVESGGGLVKPGGSLRLSCAASGFTFS<br>RYNMNWVRQAPGKGLEWVSSISTSSNYIYYADSVKGRFTFSRDNAKNSLD<br>LQMSGLRAEDTAIYYCTRGWGPFDYWGQGTLVTVSS | 68 |
| CD3W246_HL | EVQLVESGGGLVKPGGSLRLSCAASGFTFSRYNMNWVRQAPGKGLEWVS<br>SISTSSNYIYYADSVKGRFTFSRDNAKNSLDLQMSGLRAEDTAIYYCTRGWG<br>PFDYWGQGTLVTVSSGGSEGKSSGSGSESKSTGGSDIQMTQSPSSLSASVG<br>DRVTITCRARQSIGTAIHWYQQKPGKAPKLLIKYASESISGVPSRFSGSGSGT<br>DFTLTISSVQPEDFATYYCQQSGSWPYTFGQGTKLEIK | 69 |
| CD3W246_LH | DIQMTQSPSSLSASVGDRVTITCRARQSIGTAIHWYQQKPGKAPKLLIKYAS<br>ESISGVPSRFSGSGSGTDFTLTISSVQPEDFATYYCQQSGSWPYTFGQGTKL<br>EIKGGSEGKSSGSGSESKSTGGSEVQLVESGGGLVKPGGSLRLSCAASGFTF<br>SRYNMNWVRQAPGKGLEWVSSISTSSNYIYYADSVKGRFTFSRDNAKNSL<br>DLQMSGLRAEDTAIYYCTRGWGPFDYWGQGTLVTVSS | 70 |
| CD3W247_HL | EVQLVESGGGLVKPGGSLRLSCAASGFTFSRYNMNWVRQAPGKGLEWVS<br>SISTSSNYIYYADSVKGRFTFSRDNAKNSLDLQMSGLRAEDTAIYYCTRGWG<br>PFDYWGQGTLVTVSSGGSEGKSSGSGSESKSTGGSDIQMTQSPSSLSASVG<br>DRVTITCRARQSIGTAIHWYQQKPGKAPKLLIYYASESISGVPSRFSGSGSGT<br>DFTLTISSLQPEDFATYYCQQSGSWPYTFGQGTKLEIK | 71 |
| CD3W247_LH | DIQMTQSPSSLSASVGDRVTITCRARQSIGTAIHWYQQKPGKAPKLLIYYAS<br>ESISGVPSRFSGSGSGTDFTLTISSLQPEDFATYYCQQSGSWPYTFGQGTKLE<br>IKGGSEGKSSGSGSESKSTGGSEVQLVESGGGLVKPGGSLRLSCAASGFTFS<br>RYNMNWVRQAPGKGLEWVSSISTSSNYIYYADSVKGRFTFSRDNAKNSLD<br>LQMSGLRAEDTAIYYCTRGWGPFDYWGQGTLVTVSS | 72 |

TABLE 27-continued

| CD3 specific scFvs sequences. | | |
|---|---|---|
| Acronym | Amino acid sequence | SEQ ID NO: |
| CD3W248_HL | EVQLVESGGGLVKPGGSLRLSCAASGFTFSRYNMNWVRQAPGKGLEWVS SISTSSNYIYYADSVKGRFTFSRDNAKNSLDLQMSGLRAEDTAIYYCTRGWG PFDYWGQGTLVTVSSGGSEGKSSGSGSESKSTGGSDILLTQSPGILSVSPGE RVSFSCRARQSIGTAIHWYQQRTNGSPRLLIKYASESISGIPSRFSGSGSGTD FTLTINSVESEDIADYYCQQSGSWPYTFGGGTKLEIK | 73 |
| CD3W248_LH | DILLTQSPGILSVSPGERVSFSCRARQSIGTAIHWYQQRTNGSPRLLIKYASES ISGIPSRFSGSGSGTDFTLTINSVESEDIADYYCQQSGSWPYTFGGGTKLEIK GGSEGKSSGSGSESKSTGGSEVQLVESGGGLVKPGGSLRLSCAASGFTFSRY NMNWVRQAPGKGLEWVSSISTSSNYIYYADSVKGRFTFSRDNAKNSLDLQ MSGLRAEDTAIYYCTRGWGPFDYWGQGTLVTVSS | 74 |

TABLE 28

| CD3 specific scFv-Fc (scFv-hinge CH2-CH3) arms. | | | |
|---|---|---|---|
| Acronym | Amino acid sequence (shown with the C-terminal lysin (K)) | SEQ ID NO: (with the C-terminal lysin) | SEQ ID NO: (without the C-terminal lysin) |
| CD3W244_HL-Fc | EVQLVESGGGLVKPGGSLRLSCAASGFTFSRYNMNWVR QAPGKGLEWVSSISTSSNYIYYADSVKGRFTFSRDNAKNSL DLQMSGLRAEDTAIYYCTRGWGPFDYWGQGTLVTVSSG GSEGKSSGSGSESKSTGGSDIQMTQSPSSLSASVGDRVTIT CRARQSIGTAIHWYQQKPGKAPKLLIYYASESISGVPSRFS GSGSGTDFTLTISSVQPEDFATYYCQQSGSWPYTFGQGTK LEIKEPKSSDKTHTCPPCPAPEAAGGPSVFLFPPKPKDTLM ISRTPEVTCVVVSVSHEDPEVKFNWYVDGVEVHNAKTKP REEQYNSTYRVVSVLTVLHQDWLNGKEYKCKVSNKALPA PIEKTISKAKGQPREPQVYVYPPSREEMTKNQVSLTCLVK GFYPSDIAVEWESNGQPENNYKTTPPVLDSDGSFALVSKL TVDKSRWQQGNVFSCSVMHEALHNHYTQKSLSLSPGK | 75 | 747 |
| CD3W244_LH-Fc | DIQMTQSPSSLSASVGDRVTITCRARQSIGTAIHWYQQKP GKAPKLLIYYASESISGVPSRFSGSGSGTDFTLTISSVQPEDF ATYYCQQSGSWPYTFGQGTKLEIKGGSEGKSSGSGSESKS TGGSEVQLVESGGGLVKPGGSLRLSCAASGFTFSRYNMN WVRQAPGKGLEWVSSISTSSNYIYYADSVKGRFTFSRDNA KNSLDLQMSGLRAEDTAIYYCTRGWGPFDYWGQGTLVT VSSEPKSSDKTHTCPPCPAPEAAGGPSVFLFPPKPKDTLMI SRTPEVTCVVVSVSHEDPEVKFNWYVDGVEVHNAKTKPR EEQYNSTYRVVSVLTVLHQDWLNGKEYKCKVSNKALPAPI EKTISKAKGQPREPQVYVYPPSREEMTKNQVSLTCLVKGF YPSDIAVEWESNGQPENNYKTTPPVLDSDGSFALVSKLTV DKSRWQQGNVFSCSVMHEALHNHYTQKSLSLSPGK | 76 | 748 |
| CD3W245_HL-Fc | EVQLVESGGGLVKPGGSLRLSCAASGFTFSRYNMNWVR QAPGKGLEWVSSISTSSNYIYYADSVKGRFTFSRDNAKNSL DLQMSGLRAEDTAIYYCTRGWGPFDYWGQGTLVTVSSG GSEGKSSGSGSESKSTGGSDIQMTQSPSSLSASVGDRVTIT CRARQSIGTAIHWYQQKPGKAPKLLIKYASESISGVPSRFS GSGSGTDFTLTISSLQPEDFATYYCQQSGSWPYTFGQGTK LEIKEPKSSDKTHTCPPCPAPEAAGGPSVFLFPPKPKDTLM ISRTPEVTCVVVSVSHEDPEVKFNWYVDGVEVHNAKTKP REEQYNSTYRVVSVLTVLHQDWLNGKEYKCKVSNKALPA PIEKTISKAKGQPREPQVYVYPPSREEMTKNQVSLTCLVK GFYPSDIAVEWESNGQPENNYKTTPPVLDSDGSFALVSKL TVDKSRWQQGNVFSCSVMHEALHNHYTQKSLSLSPGK | 717 | 77 |
| CD3W245_LH-Fc | DIQMTQSPSSLSASVGDRVTITCRARQSIGTAIHWYQQKP GKAPKLLIKYASESISGVPSRFSGSGSGTDFTLTISSLQPEDF ATYYCQQSGSWPYTFGQGTKLEIKGGSEGKSSGSGSESKS TGGSEVQLVESGGGLVKPGGSLRLSCAASGFTFSRYNMN WVRQAPGKGLEWVSSISTSSNYIYYADSVKGRFTFSRDNA KNSLDLQMSGLRAEDTAIYYCTRGWGPFDYWGQGTLVT VSSEPKSSDKTHTCPPCPAPEAAGGPSVFLFPPKPKDTLMI SRTPEVTCVVVSVSHEDPEVKFNWYVDGVEVHNAKTKPR | 718 | 78 |

TABLE 28-continued

CD3 specific scFv-Fc (scFv-hinge CH2-CH3) arms.

| Acronym | Amino acid sequence (shown with the C-terminal lysin (K)) | SEQ ID NO: (with the C-terminal lysin) | SEQ ID NO: (without the C-terminal lysin) |
|---|---|---|---|
| | EEQYNSTYRVVSVLTVLHQDWLNGKEYKCKVSNKALPAPI EKTISKAKGQPREPQVYVYPPSREEMTKNQVSLTCLVKGF YPSDIAVEWESNGQPENNYKTTPPVLDSDGSFALVSKLTV DKSRWQQGNVFSCSVMHEALHNHYTQKSLSLSPGK | | |
| CD3W246_HL-Fc | EVQLVESGGGLVKPGGSLRLSCAASGFTFSRYNMNWVR QAPGKGLEWVSSISTSSNYIYYADSVKGRFTFSRDNAKNSL DLQMSGLRAEDTAIYYCTRGWGPFDYWGQGTLVTVSSG GSEGKSSGSGSESKSTGGSDIQMTQSPSSLSASVGDRVTIT CRARQSIGTAIHWYQQKPGKAPKLLIKYASESISGVPSRFS GSGSGTDFTLTISSVQPEDFATYYCQQSGSWPYTFGQGTK LEIKEPKSSDKTHTCPPCPAPEAAGGPSVFLFPPKPKDTLM ISRTPEVTCVVVSVSHEDPEVKFNWYVDGVEVHNAKTKP REEQYNSTYRVVSVLTVLHQDWLNGKEYKCKVSNKALPA PIEKTISKAKGQPREPQVYVYPPSREEMTKNQVSLTCLVK GFYPSDIAVEWESNGQPENNYKTTPPVLDSDGSFALVSKL TVDKSRWQQGNVFSCSVMHEALHNHYTQKSLSLSPGK | 79 | 749 |
| CD3W246_LH-Fc | DIQMTQSPSSLSASVGDRVTITCRARQSIGTAIHWYQQKP GKAPKLLIKYASESISGVPSRFSGSGSGTDFTLTISSVQPEDF ATYYCQQSGSWPYTFGQGTKLEIKGGSEGKSSGSGSESKS TGGSEVQLVESGGGLVKPGGSLRLSCAASGFTFSRYNMN WVRQAPGKGLEWVSSISTSSNYIYYADSVKGRFTFSRDNA KNSLDLQMSGLRAEDTAIYYCTRGWGPFDYWGQGTLVT VSSEPKSSDKTHTCPPCPAPEAAGGPSVFLFPPKPKDTLMI SRTPEVTCVVVSVSHEDPEVKFNWYVDGVEVHNAKTKPR EEQYNSTYRVVSVLTVLHQDWLNGKEYKCKVSNKALPAPI EKTISKAKGQPREPQVYVYPPSREEMTKNQVSLTCLVKGF YPSDIAVEWESNGQPENNYKTTPPVLDSDGSFALVSKLTV DKSRWQQGNVFSCSVMHEALHNHYTQKSLSLSPGK | 80 | 750 |
| CD3W247_HL-Fc | EVQLVESGGGLVKPGGSLRLSCAASGFTFSRYNMNWVR QAPGKGLEWVSSISTSSNYIYYADSVKGRFTFSRDNAKNSL DLQMSGLRAEDTAIYYCTRGWGPFDYWGQGTLVTVSSG GSEGKSSGSGSESKSTGGSDIQMTQSPSSLSASVGDRVTIT CRARQSIGTAIHWYQQKPGKAPKLLIYYASESISGVPSRFS GSGSGTDFTLTISSLQPEDFATYYCQQSGSWPYTFGQGTK LEIKEPKSSDKTHTCPPCPAPEAAGGPSVFLFPPKPKDTLM ISRTPEVTCVVVSVSHEDPEVKFNWYVDGVEVHNAKTKP REEQYNSTYRVVSVLTVLHQDWLNGKEYKCKVSNKALPA PIEKTISKAKGQPREPQVYVYPPSREEMTKNQVSLTCLVK GFYPSDIAVEWESNGQPENNYKTTPPVLDSDGSFALVSKL TVDKSRWQQGNVFSCSVMHEALHNHYTQKSLSLSPGK | 81 | 751 |
| CD3W247_LH-Fc | DIQMTQSPSSLSASVGDRVTITCRARQSIGTAIHWYQQKP GKAPKLLIYYASESISGVPSRFSGSGSGTDFTLTISSLQPEDF ATYYCQQSGSWPYTFGQGTKLEIKGGSEGKSSGSGSESKS TGGSEVQLVESGGGLVKPGGSLRLSCAASGFTFSRYNMN WVRQAPGKGLEWVSSISTSSNYIYYADSVKGRFTFSRDNA KNSLDLQMSGLRAEDTAIYYCTRGWGPFDYWGQGTLVT VSSEPKSSDKTHTCPPCPAPEAAGGPSVFLFPPKPKDTLMI SRTPEVTCVVVSVSHEDPEVKFNWYVDGVEVHNAKTKPR EEQYNSTYRVVSVLTVLHQDWLNGKEYKCKVSNKALPAPI EKTISKAKGQPREPQVYVYPPSREEMTKNQVSLTCLVKGF YPSDIAVEWESNGQPENNYKTTPPVLDSDGSFALVSKLTV DKSRWQQGNVFSCSVMHEALHNHYTQKSLSLSPGK | 82 | 752 |
| CD3W248_HL-Fc | EVQLVESGGGLVKPGGSLRLSCAASGFTFSRYNMNWVR QAPGKGLEWVSSISTSSNYIYYADSVKGRFTFSRDNAKNSL DLQMSGLRAEDTAIYYCTRGWGPFDYWGQGTLVTVSSG GSEGKSSGSGSESKSTGGSDILLTQSPGILSVSPGERVSFSC RARQSIGTAIHWYQQRTNGSPRLLIKYASESISGIPSRFSGS GSGTDFTLTINSVESEDIADYYCQQSGSWPYTFGGGTKLEI KEPKSSDKTHTCPPCPAPEAAGGPSVFLFPPKPKDTLMISR TPEVTCVVVSVSHEDPEVKFNWYVDGVEVHNAKTKPREE QYNSTYRVVSVLTVLHQDWLNGKEYKCKVSNKALPAPIEK TISKAKGQPREPQVYVYPPSREEMTKNQVSLTCLVKGFYP SDIAVEWESNGQPENNYKTTPPVLDSDGSFALVSKLTVDK SRWQQGNVFSCSVMHEALHNHYTQKSLSLSPGK | 83 | 753 |
| CD3W248_LH-Fc | DILLTQSPGILSVSPGERVSFSCRARQSIGTAIHWYQQRTN GSPRLLIKYASESISGIPSRFSGSGSGTDFTLTINSVESEDIAD YYCQQSGSWPYTFGGGTKLEIKGGSEGKSSGSGSESKSTG | 84 | 754 |

TABLE 28-continued

| CD3 specific scFv-Fc (scFv-hinge CH2-CH3) arms. | | | |
|---|---|---|---|
| Acronym | Amino acid sequence (shown with the C-terminal lysin (K)) | SEQ ID NO: (with the C-terminal lysin) | SEQ ID NO: (without the C-terminal lysin) |
| | GSEVQLVESGGGLVKPGGSLRLSCAASGFTFSRYNMNWV RQAPGKGLEWVSSISTSSNYIYYADSVKGRFTFSRDNAKN SLDLQMSGLRAEDTAIYYCTRGWGPFDYWGQGTLVTVS SEPKSSDKTHTCPPCPAPEAAGGPSVFLFPPKPKDTLMISR TPEVTCVVVSVSHEDPEVKFNWYVDGVEVHNAKTKPREE QYNSTYRVVSVLTVLHQDWLNGKEYKCKVSNKALPAPIEK TISKAKGQPREPQVYVYPPSREEMTKNQVSLTCLVKGFYP SDIAVEWESNGQPENNYKTTPPVLDSDGSFALVSKLTVDK SRWQQGNVFSCSVMHEALHNHYTQKSLSLSPGK | | |

TABLE 29

| DNA SEQ ID NOs for anti-CD3 scFv and scFv-hinge-CH2-CH3 (scFv-Fc) | | |
|---|---|---|
| | scFv DNA SEQ ID NO | scFv-Fc DNA SEQ ID NO |
| CD3W244_HL | 294 | 304 |
| CD3W244_LH | 295 | 305 |
| CD3W245_HL | 296 | 306 |
| CD3W245_LH | 297 | 307 |
| CD3W246_HL | 298 | 308 |
| CD3W246_LH | 299 | 309 |
| CD3W247_HL | 300 | 310 |
| CD3W247_LH | 301 | 311 |
| CD3W248_HL | 302 | 312 |
| CD3W248_LH | 303 | 313 |

SEQ ID NO: 294 (CD3W244_HL)
GAGGTGCAGCTGGTGGAGAGCGGTGGCGGTCTGGTGAAGCCAGGTGGCAGCCTGCG
CCTGAGCTGTGCCGCCAGCGGTTTCACCTTCAGCCGCTACAACATGAACTGGGTGCGCCAAG
CCCCAGGCAAGGGCCTGGAGTGGGTGAGCAGCATCAGCACCAGCAGCAACTACATCTACTA
CGCCGACAGCGTGAAGGGCCGCTTCACCTTCAGCCGCGACAACGCCAAGAACAGCCTGGAC
CTGCAGATGAGCGGTCTGCGCGCCGAGGACACCGCCATCTACTACTGCACCCGCGGTTGGGG
CCCATTCGACTACTGGGGCCAGGGCACCCTGGTGACCGTGAGCAGCGGCGGATCTGAGGGA
AAGTCCAGCGGCTCCGGCAGCGAAAGCAAGTCCACCGGCGGAAGCGACATCCAGATGACCC
AGAGCCCAAGCAGCCTGAGCGCCAGCGTCGGCGACCGCGTGACCATCACCTGTCGTGCCCG
CCAGAGCATCGGCACCGCCATCCACTGGTACCAGCAGAAGCCAGGCAAGGCCCCAAAGCTG
CTGATCTACTACGCCAGCGAGAGCATCAGCGGTGTGCCAAGCCGCTTCAGCGGCAGCGGCA
GCGGCACCGACTTCACCCTGACCATCAGCAGCGTGCAGCCAGAGGACTTCGCCACCTACTAC
TGCCAGCAGAGCGGCAGCTGGCCATACACCTTCGGCCAGGGCACCAAGCTGGAGATCAAG

SEQ ID NO: 295 (CD3W244_LH)
GACATCCAGATGACCCAGAGCCCAAGCAGCCTGAGCGCCAGCGTCGGCGACCGCGT
GACCATCACCTGTCGTGCCCGCCAGAGCATCGGCACCGCCATCCACTGGTACCAGCAGAAGC
CAGGCAAGGCCCCAAAGCTGCTGATCTACTACGCCAGCGAGAGCATCAGCGGTGTGCCAAG
CCGCTTCAGCGGCAGCGGCAGCGGCACCGACTTCACCCTGACCATCAGCAGCGTGCAGCCA
GAGGACTTCGCCACCTACTACTGCCAGCAGAGCGGCAGCTGGCCATACACCTTCGGCCAGG
GCACCAAGCTGGAGATCAAGGGCGGATCTGAGGGAAAGTCCAGCGGCTCCGGCAGCGAAA
GCAAGTCCACCGGCGGAAGCGAGGTGCAGCTGGTGGAGAGCGGTGGCGGTCTGGTGAAGCC
AGGTGGCAGCCTGCGCCTGAGCTGTGCCGCCAGCGGTTTCACCTTCAGCCGCTACAACATGA
ACTGGGTGCGCCAAGCCCCAGGCAAGGGCCTGGAGTGGGTGAGCAGCATCAGCACCAGCAG
CAACTACATCTACTACGCCGACAGCGTGAAGGGCCGCTTCACCTTCAGCCGCGACAACGCCA
AGAACAGCCTGGACCTGCAGATGAGCGGTCTGCGCGCCGAGGACACCGCCATCTACTACTG
CACCCGCGGTTGGGGCCCATTCGACTACTGGGGCCAGGGCACCCTGGTGACCGTGAGCAGC

SEQ ID NO: 296 (CD3W245_HL)
GAGGTGCAGCTGGTGGAGAGCGGTGGCGGTCTGGTGAAGCCAGGTGGCAGCCTGCG
CCTGAGCTGTGCCGCCAGCGGTTTCACCTTCAGCCGCTACAACATGAACTGGGTGCGCCAAG

TABLE 29-continued

DNA SEQ ID NOs for anti-CD3 scFv and scFv-hinge-CH2-CH3 (scFv-Fc)

CCCCAGGCAAGGGCCTGGAGTGGGTGAGCAGCATCAGCACCAGCAGCAACTACATCTACTA
CGCCGACAGCGTGAAGGGCCGCTTCACCTTCAGCCGCGACAACGCCAAGAACAGCCTGGAC
CTGCAGATGAGCGGTCTGCGCGCCGAGGACACCGCCATCTACTACTGCACCCGCGGTTGGGG
CCCATTCGACTACTGGGGCCAGGGCACCCTGGTGACCGTGAGCAGCGGCGGATCTGAGGGA
AAGTCCAGCGGCTCCGGCAGCGAAAGCAAGTCCACCGGCGGAAGCGACATCCAGATGACCC
AGAGCCCAAGCAGCCTGAGCGCCAGCGTCGGCGACCGCGTGACCATCACCTGTCGTGCCCG
CCAGAGCATCGGCACCGCCATCCACTGGTACCAGCAGAAGCCAGGCAAGGCCCCAAAGCTG
CTGATCAAGTACGCCAGCGAGAGCATCAGCGGTGTGCCAAGCCGCTTCAGCGGCAGCGGCA
GCGGCACCGACTTCACCCTGACCATCAGCAGCCTGCAGCCAGAGGACTTCGCCACCTACTAC
TGCCAGCAGAGCGGCAGCTGGCCATACACCTTCGGCCAGGGCACCAAGCTGGAGATCAAG

SEQ ID NO: 297 (CD3W245_LH)
GACATCCAGATGACCCAGAGCCCAAGCAGCCTGAGCGCCAGCGTCGGCGACCGCGT
GACCATCACCTGTCGTGCCCGCCAGAGCATCGGCACCGCCATCCACTGGTACCAGCAGAAGC
CAGGCAAGGCCCCAAAGCTGCTGATCAAGTACGCCAGCGAGAGCATCAGCGGTGTGCCAAG
CCGCTTCAGCGGCAGCGGCAGCGGCACCGACTTCACCCTGACCATCAGCAGCCTGCAGCCA
GAGGACTTCGCCACCTACTACTGCCAGCAGAGCGGCAGCTGGCCATACACCTTCGGCCAGG
GCACCAAGCTGGAGATCAAGGGCGGATCTGAGGGAAAGTCCAGCGGCTCCGGCAGCGAAA
GCAAGTCCACCGGCGGAAGCGAGGTGCAGCTGGTGGAGAGCGGTGGCGGTCTGGTGAAGCC
AGGTGGCAGCCTGCGCCTGAGCTGTGCCGCCAGCGGTTTCACCTTCAGCCGCTACAACATGA
ACTGGGTGCGCCAAGCCCCAGGCAAGGGCCTGGAGTGGGTGAGCAGCATCAGCACCAGCAG
CAACTACATCTACTACGCCGACAGCGTGAAGGGCCGCTTCACCTTCAGCCGCGACAACGCCA
AGAACAGCCTGGACCTGCAGATGAGCGGTCTGCGCGCCGAGGACACCGCCATCTACTACTG
CACCCGCGGTTGGGGCCCATTCGACTACTGGGGCCAGGGCACCCTGGTGACCGTGAGCAGC

SEQ ID NO: 298 (CD3W246_HL)
GAGGTGCAGCTGGTGGAGAGCGGTGGCGGTCTGGTGAAGCCAGGTGGCAGCCTGCG
CCTGAGCTGTGCCGCCAGCGGTTTCACCTTCAGCCGCTACAACATGAACTGGGTGCGCCAAG
CCCCAGGCAAGGGCCTGGAGTGGGTGAGCAGCATCAGCACCAGCAGCAACTACATCTACTA
CGCCGACAGCGTGAAGGGCCGCTTCACCTTCAGCCGCGACAACGCCAAGAACAGCCTGGAC
CTGCAGATGAGCGGTCTGCGCGCCGAGGACACCGCCATCTACTACTGCACCCGCGGTTGGGG
CCCATTCGACTACTGGGGCCAGGGCACCCTGGTGACCGTGAGCAGCGGCGGATCTGAGGGA
AAGTCCAGCGGCTCCGGCAGCGAAAGCAAGTCCACCGGCGGAAGCGACATCCAGATGACCC
AGAGCCCAAGCAGCCTGAGCGCCAGCGTCGGCGACCGCGTGACCATCACCTGTCGTGCCCG
CCAGAGCATCGGCACCGCCATCCACTGGTACCAGCAGAAGCCAGGCAAGGCCCCAAAGCTG
CTGATCAAGTACGCCAGCGAGAGCATCAGCGGTGTGCCAAGCCGCTTCAGCGGCAGCGGCA
GCGGCACCGACTTCACCCTGACCATCAGCAGCGTGCAGCCAGAGGACTTCGCCACCTACTAC
TGCCAGCAGAGCGGCAGCTGGCCATACACCTTCGGCCAGGGCACCAAGCTGGAGATCAAG

SEQ ID NO: 299 (CD3W246_LH)
GACATCCAGATGACCCAGAGCCCAAGCAGCCTGAGCGCCAGCGTCGGCGACCGCGT
GACCATCACCTGTCGTGCCCGCCAGAGCATCGGCACCGCCATCCACTGGTACCAGCAGAAGC
CAGGCAAGGCCCCAAAGCTGCTGATCAAGTACGCCAGCGAGAGCATCAGCGGTGTGCCAAG
CCGCTTCAGCGGCAGCGGCAGCGGCACCGACTTCACCCTGACCATCAGCAGCGTGCAGCCA
GAGGACTTCGCCACCTACTACTGCCAGCAGAGCGGCAGCTGGCCATACACCTTCGGCCAGG
GCACCAAGCTGGAGATCAAGGGCGGATCTGAGGGAAAGTCCAGCGGCTCCGGCAGCGAAA
GCAAGTCCACCGGCGGAAGCGAGGTGCAGCTGGTGGAGAGCGGTGGCGGTCTGGTGAAGCC
AGGTGGCAGCCTGCGCCTGAGCTGTGCCGCCAGCGGTTTCACCTTCAGCCGCTACAACATGA
ACTGGGTGCGCCAAGCCCCAGGCAAGGGCCTGGAGTGGGTGAGCAGCATCAGCACCAGCAG
CAACTACATCTACTACGCCGACAGCGTGAAGGGCCGCTTCACCTTCAGCCGCGACAACGCCA
AGAACAGCCTGGACCTGCAGATGAGCGGTCTGCGCGCCGAGGACACCGCCATCTACTACTG
CACCCGCGGTTGGGGCCCATTCGACTACTGGGGCCAGGGCACCCTGGTGACCGTGAGCAGC

SEQ ID NO: 300 (CD3W247_HL)
GAGGTGCAGCTGGTGGAGAGCGGTGGCGGTCTGGTGAAGCCAGGTGGCAGCCTGCG
CCTGAGCTGTGCCGCCAGCGGTTTCACCTTCAGCCGCTACAACATGAACTGGGTGCGCCAAG
CCCCAGGCAAGGGCCTGGAGTGGGTGAGCAGCATCAGCACCAGCAGCAACTACATCTACTA
CGCCGACAGCGTGAAGGGCCGCTTCACCTTCAGCCGCGACAACGCCAAGAACAGCCTGGAC
CTGCAGATGAGCGGTCTGCGCGCCGAGGACACCGCCATCTACTACTGCACCCGCGGTTGGGG
CCCATTCGACTACTGGGGCCAGGGCACCCTGGTGACCGTGAGCAGCGGCGGATCTGAGGGA
AAGTCCAGCGGCTCCGGCAGCGAAAGCAAGTCCACCGGCGGAAGCGACATCCAGATGACCC
AGAGCCCAAGCAGCCTGAGCGCCAGCGTCGGCGACCGCGTGACCATCACCTGTCGTGCCCG
CCAGAGCATCGGCACCGCCATCCACTGGTACCAGCAGAAGCCAGGCAAGGCCCCAAAGCTG
CTGATCTACTACGCCAGCGAGAGCATCAGCGGTGTGCCAAGCCGCTTCAGCGGCAGCGGCA
GCGGCACCGACTTCACCCTGACCATCAGCAGCCTGCAGCCAGAGGACTTCGCCACCTACTAC
TGCCAGCAGAGCGGCAGCTGGCCATACACCTTCGGCCAGGGCACCAAGCTGGAGATCAAG

SEQ ID NO: 301 (CD3W247_LH)
GACATCCAGATGACCCAGAGCCCAAGCAGCCTGAGCGCCAGCGTCGGCGACCGCGT
GACCATCACCTGTCGTGCCCGCCAGAGCATCGGCACCGCCATCCACTGGTACCAGCAGAAGC
CAGGCAAGGCCCCAAAGCTGCTGATCTACTACGCCAGCGAGAGCATCAGCGGTGTGCCAAG
CCGCTTCAGCGGCAGCGGCAGCGGCACCGACTTCACCCTGACCATCAGCAGCCTGCAGCCA
GAGGACTTCGCCACCTACTACTGCCAGCAGAGCGGCAGCTGGCCATACACCTTCGGCCAGG
GCACCAAGCTGGAGATCAAGGGCGGATCTGAGGGAAAGTCCAGCGGCTCCGGCAGCGAAA
GCAAGTCCACCGGCGGAAGCGAGGTGCAGCTGGTGGAGAGCGGTGGCGGTCTGGTGAAGCC
AGGTGGCAGCCTGCGCCTGAGCTGTGCCGCCAGCGGTTTCACCTTCAGCCGCTACAACATGA
ACTGGGTGCGCCAAGCCCCAGGCAAGGGCCTGGAGTGGGTGAGCAGCATCAGCACCAGCAG

TABLE 29-continued

| DNA SEQ ID NOs for anti-CD3 scFv and scFv-hinge-CH2-CH3 (scFv-Fc) |
|---|
| CAACTACATCTACTACGCCGACAGCGTGAAGGGCCGCTTCACCTTCAGCCGCGACAACGCCA<br>AGAACAGCCTGGACCTGCAGATGAGCGGTCTGCGCGCCGAGGACACCGCCATCTACTACTG<br>CACCCGCGGTTGGGGCCCATTCGACTACTGGGGCCAGGGCACCCTGGTGACCGTGAGCAGC |
| SEQ ID NO: 302 (CD3W248_HL)<br>GAGGTGCAACTGGTGGAGTCTGGGGGAGGCCTGGTCAAGCCTGGGGGGTCCCTGAG<br>ACTCTCCTGTGCAGCCTCTGGATTCACCTTCAGTAGATATAACATGAACTGGGTCCGCCAGG<br>CTCCAGGGAAGGGGCTGGAGTGGGTCTCATCCATTAGTACTAGTAGTAATTACATATACTAC<br>GCAGACTCAGTGAAGGGCCGATTCACCTTCTCCAGAGACAACGCCAAGAACTCACTGGATCT<br>GCAAATGAGCGGCCTGAGAGCCGAGGACACGGCTATTTATTACTGTACGAGAGGCTGGGGG<br>CCTTTTGACTACTGGGGCCAGGGAACCCTGGTCACCGTCTCCTCAGGCGGATCTGAGGGAAA<br>GTCCAGCGGCTCCGGCAGCGAAAGCAAGTCCACCGGCGGAAGCGACATCTTGCTGACTCAG<br>TCTCCAGGCATCCTGTCTGTGAGTCCAGGAGAAAGAGTCAGTTTCTCCTGCAGGGCCAGACA<br>GAGCATTGGCACAGCCATACACTGGTATCAGCAAAGAACAAATGGTTCTCCAAGGCTTCTCA<br>TAAAGTATGCTTCTGAGTCTATCTCTGGGATCCCTTCCAGGTTTAGCGGCAGTGGATCAGGG<br>ACAGATTTTACTCTTACCATCAACAGTGTGGAGTCTGAAGATATTGCAGATTATTACTGTCA<br>ACAAAGTGGGAGCTGGCCGTACACGTTCGGAGGGGGGACCAAGCTGGAAATAAAA |
| SEQ ID NO: 303 (CD3W248_LH)<br>GACATCTTGCTGACTCAGTCTCCAGGCATCCTGTCTGTGAGTCCAGGAGAAAGAGTC<br>AGTTTCTCCTGCAGGGCCAGACAGAGCATTGGCACAGCCATACACTGGTATCAGCAAAGAA<br>CAAATGGTTCTCCAAGGCTTCTCATAAAGTATGCTTCTGAGTCTATCTCTGGGATCCCTTCCA<br>GGTTTAGCGGCAGTGGATCAGGGACAGATTTTACTCTTACCATCAACAGTGTGGAGTCTGAA<br>GATATTGCAGATTATTACTGTCAACAAAGTGGGAGCTGGCCGTACACGTTCGGAGGGGGGA<br>CCAAGCTGGAAATAAAAGGCGGATCTGAGGGAAAGTCCAGCGGCTCCGGCAGCGAAAGCA<br>AGTCCACCGGCGGAAGCGAGGTGCAACTGGTGGAGTCTGGGGGAGGCCTGGTCAAGCCTGG<br>GGGGTCCCTGAGACTCTCCTGTGCAGCCTCTGGATTCACCTTCAGTAGATATAACATGAACT<br>GGGTCCGCCAGGCTCCAGGGAAGGGGCTGGAGTGGGTCTCATCCATTAGTACTAGTAGTAAT<br>TACATATACTACGCAGACTCAGTGAAGGGCCGATTCACCTTCTCCAGAGACAACGCCAAGA<br>ACTCACTGGATCTGCAAATGAGCGGCCTGAGAGCCGAGGACACGGCTATTTATTACTGTACG<br>AGAGGCTGGGGGCCTTTTGACTACTGGGGCCAGGGAACCCTGGTCACCGTCTCCTCA |
| SEQ ID NO: 304 (CD3W244_HL-scFv-Fc)<br>GAGGTGCAGCTGGTGGAGAGCGGTGGCGGTCTGGTGAAGCCAGGTGGCAGCCTGCG<br>CCTGAGCTGTGCCGCCAGCGGTTTCACCTTCAGCCGCTACAACATGAACTGGGTGCGCCAAG<br>CCCCAGGCAAGGGCCTGGAGTGGGTGAGCAGCATCAGCACCAGCAGCAACTACATCTACTA<br>CGCCGACAGCGTGAAGGGCCGCTTCACCTTCAGCCGCGACAACGCCAAGAACAGCCTGGAC<br>CTGCAGATGAGCGGTCTGCGCGCCGAGGACACCGCCATCTACTACTGCACCCGCGGTTGGGG<br>CCCATTCGACTACTGGGGCCAGGGCACCCTGGTGACCGTGAGCAGCGGCGGATCTGAGGGA<br>AAGTCCAGCGGCTCCGGCAGCGAAAGCAAGTCCACCGGCGGAAGCGACATCCAGATGACCC<br>AGAGCCCAAGCAGCCTGAGCGCCAGCGTCGGCGACCGCGTGACCATCACCTGTCGTGCCCG<br>CCAGAGCATCGGCACCGCCATCCACTGGTACCAGCAGAAGCCAGGCAAGGCCCCAAAGCTG<br>CTGATCTACTACGCCAGCGAGAGCATCAGCGGTGTGCCAAGCCGCTTCAGCGGCAGCGGCA<br>GCGGCACCGACTTCACCCTGACCATCAGCAGCGTGCAGCCAGAGGACTTCGCCACCTACTAC<br>TGCCAGCAGAGCGGCAGCTGGCCATACACCTTCGGCCAGGGCACCAAGCTGGAGATCAAGG<br>AGCCCAAATCTAGCGACAAAACTCACACATGTCCACCGTGCCCAGCACCTGAAGCAGCAGG<br>GGGACCGTCAGTCTTCCTCTTCCCCCCAAAACCCAAGGACACCCTCATGATCTCCCGGACCC<br>CTGAGGTCACATGCGTGGTGGTGAGCGTGAGCCACGAAGACCCTGAGGTCAAGTTCAACTG<br>GTACGTGGACGGCGTGGAGGTGCATAATGCCAAGACAAAGCCGCGGGAGGAGCAGTACAA<br>CAGCACGTACCGTGTGGTCAGCGTCCTCACCGTCCTGCACCAGGACTGGCTGAATGGCAAGG<br>AGTACAAGTGCAAGGTCTCCAACAAAGCCCTCCCAGCCCCCATCGAGAAAACCATCTCCAA<br>AGCCAAAGGGCAGCCCCGAGAACCACAGGTGTACGTGTACCCCCCATCCCGGGAGGAGATG<br>ACCAAGAACCAGGTCAGCCTGACCTGCCTGGTCAAAGGCTTCTATCCCAGCGACATCGCCGT<br>GGAGTGGGAGAGCAATGGGCAGCCGGAGAACAACTACAAGACCACGCCTCCCGTGCTGGAC<br>TCCGACGGCTCCTTCGCCCTCGTGAGCAAGCTCACCGTGGACAAGTCTAGATGGCAGCAGGG<br>GAACGTCTTCTCATGCTCCGTGATGCATGAGGCTCTGCACAACCACTACACGCAGAAGAGCC<br>TCTCCCTGTCTCCGGGTAAA |
| SEQ ID NO: 305 (CD3W244_LH-scFv-Fc)<br>GACATCCAGATGACCCAGAGCCCAAGCAGCCTGAGCGCCAGCGTCGGCGACCGCGT<br>GACCATCACCTGTCGTGCCCGCCAGAGCATCGGCACCGCCATCCACTGGTACCAGCAGAAGC<br>CAGGCAAGGCCCCAAAGCTGCTGATCTACTACGCCAGCGAGAGCATCAGCGGTGTGCCAAG<br>CCGCTTCAGCGGCAGCGGCAGCGGCACCGACTTCACCCTGACCATCAGCAGCGTGCAGCCA<br>GAGGACTTCGCCACCTACTACTGCCAGCAGAGCGGCAGCTGGCCATACACCTTCGGCCAGG<br>GCACCAAGCTGGAGATCAAGGGCGGATCTGAGGGAAAGTCCAGCGGCTCCGGCAGCGAAA<br>GCAAGTCCACCGGCGGAAGCGAGGTGCAGCTGGTGGAGAGCGGTGGCGGTCTGGTGAAGCC<br>AGGTGGCAGCCTGCGCCTGAGCTGTGCCGCCAGCGGTTTCACCTTCAGCCGCTACAACATGA<br>ACTGGGTGCGCCAAGCCCCAGGCAAGGGCCTGGAGTGGGTGAGCAGCATCAGCACCAGCAG<br>CAACTACATCTACTACGCCGACAGCGTGAAGGGCCGCTTCACCTTCAGCCGCGACAACGCCA<br>AGAACAGCCTGGACCTGCAGATGAGCGGTCTGCGCGCCGAGGACACCGCCATCTACTACTG<br>CACCCGCGGTTGGGGCCCATTCGACTACTGGGGCCAGGGCACCCTGGTGACCGTGAGCAGC<br>GAGCCCAAATCTAGCGACAAAACTCACACATGTCCACCGTGCCCAGCACCTGAAGCAGCAG<br>GGGGACCGTCAGTCTTCCTCTTCCCCCCAAAACCCAAGGACACCCTCATGATCTCCCGGACC<br>CCTGAGGTCACATGCGTGGTGGTGAGCGTGAGCCACGAAGACCCTGAGGTCAAGTTCAACT<br>GGTACGTGGACGGCGTGGAGGTGCATAATGCCAAGACAAAGCCGCGGGAGGAGCAGTACA<br>ACAGCACGTACCGTGTGGTCAGCGTCCTCACCGTCCTGCACCAGGACTGGCTGAATGGCAAG<br>GAGTACAAGTGCAAGGTCTCCAACAAAGCCCTCCCAGCCCCCATCGAGAAAACCATCTCCA |

TABLE 29-continued

DNA SEQ ID NOs for anti-CD3 scFv and scFv-hinge-CH2-CH3 (scFv-Fc)

AAGCCAAAGGGCAGCCCCGAGAACCACAGGTGTACGTGTACCCCCCATCCCGGGAGGAGAT
GACCAAGAACCAGGTCAGCCTGACCTGCCTGGTCAAAGGCTTCTATCCCAGCGACATCGCCG
TGGAGTGGGAGAGCAATGGGCAGCCGGAGAACAACTACAAGACCACGCCTCCCGTGCTGGA
CTCCGACGGCTCCTTCGCCCTCGTGAGCAAGCTCACCGTGGACAAGTCTAGATGGCAGCAGG
GGAACGTCTTCTCATGCTCCGTGATGCATGAGGCTCTGCACAACCACTACACGCAGAAGAGC
CTCTCCCTGTCTCCGGGTAAA

SEQ ID NO: 306 (CD3W245_HL-scFv-Fc)
GAGGTGCAGCTGGTGGAGAGCGGTGGCGGTCTGGTGAAGCCAGGTGGCAGCCTGCG
CCTGAGCTGTGCCGCCAGCGGTTTCACCTTCAGCCGCTACAACATGAACTGGGTGCGCCAAG
CCCCAGGCAAGGGCCTGGAGTGGGTGAGCAGCATCAGCACCAGCAGCAACTACATCTACTA
CGCCGACAGCGTGAAGGGCCGCTTCACCTTCAGCCGCGACAACGCCAAGAACAGCCTGGAC
CTGCAGATGAGCGGTCTGCGCGCCGAGGACACCGCCATCTACTACTGCACCCGCGGTTGGGG
CCCATTCGACTACTGGGGCCAGGGCACCCTGGTGACCGTGAGCAGCGGCGGATCTGAGGGA
AAGTCCAGCGGCTCCGGCAGCGAAAGCAAGTCCACCGGCGGAAGCGACATCCAGATGACCC
AGAGCCCAAGCAGCCTGAGCGCCAGCGTCGGCGACCGCGTGACCATCACCTGTCGTGCCCG
CCAGAGCATCGGCACCGCCATCCACTGGTACCAGCAGAAGCCAGGCAAGGCCCCAAAGCTG
CTGATCAAGTACGCCAGCGAGAGCATCAGCGGTGTGCCAAGCCGCTTCAGCGGCAGCGGCA
GCGGCACCGACTTCACCCTGACCATCAGCAGCCTGCAGCCAGAGGACTTCGCCACCTACTAC
TGCCAGCAGAGCGGCAGCTGGCCATACACCTTCGGCCAGGGCACCAAGCTGGAGATCAAGG
AGCCCAAATCTAGCGACAAAACTCACACATGTCCACCGTGCCCAGCACCTGAAGCAGCAGG
GGGACCGTCAGTCTTCCTCTTCCCCCCAAAACCCAAGGACACCCTCATGATCTCCCGGACCC
CTGAGGTCACATGCGTGGTGGTGAGCGTGAGCCACGAAGACCCTGAGGTCAAGTTCAACTG
GTACGTGGACGGCGTGGAGGTGCATAATGCCAAGACAAAGCCGCGGGAGGAGCAGTACAA
CAGCACGTACCGTGTGGTCAGCGTCCTCACCGTCCTGCACCAGGACTGGCTGAATGGCAAGG
AGTACAAGTGCAAGGTCTCCAACAAAGCCCTCCCAGCCCCCATCGAGAAAACCATCTCCAA
AGCCAAAGGGCAGCCCCGAGAACCACAGGTGTACGTGTACCCCCCATCCCGGGAGGAGATG
ACCAAGAACCAGGTCAGCCTGACCTGCCTGGTCAAAGGCTTCTATCCCAGCGACATCGCCGT
GGAGTGGGAGAGCAATGGGCAGCCGGAGAACAACTACAAGACCACGCCTCCCGTGCTGGAC
TCCGACGGCTCCTTCGCCCTCGTGAGCAAGCTCACCGTGGACAAGTCTAGATGGCAGCAGGG
GAACGTCTTCTCATGCTCCGTGATGCATGAGGCTCTGCACAACCACTACACGCAGAAGAGCC
TCTCCCTGTCTCCGGGTAAA

SEQ ID NO: 307 (CD3W245_LH-scFv-Fc)
GACATCCAGATGACCCAGAGCCCAAGCAGCCTGAGCGCCAGCGTCGGCGACCGCGT
GACCATCACCTGTCGTGCCCGCCAGAGCATCGGCACCGCCATCCACTGGTACCAGCAGAAGC
CAGGCAAGGCCCCAAAGCTGCTGATCAAGTACGCCAGCGAGAGCATCAGCGGTGTGCCAAG
CCGCTTCAGCGGCAGCGGCAGCGGCACCGACTTCACCCTGACCATCAGCAGCCTGCAGCCA
GAGGACTTCGCCACCTACTACTGCCAGCAGAGCGGCAGCTGGCCATACACCTTCGGCCAGG
GCACCAAGCTGGAGATCAAGGGCGGATCTGAGGGAAAGTCCAGCGGCTCCGGCAGCGAAA
GCAAGTCCACCGGCGGAAGCGAGGTGCAGCTGGTGGAGAGCGGTGGCGGTCTGGTGAAGCC
AGGTGGCAGCCTGCGCCTGAGCTGTGCCGCCAGCGGTTTCACCTTCAGCCGCTACAACATGA
ACTGGGTGCGCCAAGCCCCAGGCAAGGGCCTGGAGTGGGTGAGCAGCATCAGCACCAGCAG
CAACTACATCTACTACGCCGACAGCGTGAAGGGCCGCTTCACCTTCAGCCGCGACAACGCCA
AGAACAGCCTGGACCTGCAGATGAGCGGTCTGCGCGCCGAGGACACCGCCATCTACTACTG
CACCCGCGGTTGGGGCCCATTCGACTACTGGGGCCAGGGCACCCTGGTGACCGTGAGCAGC
GAGCCCAAATCTAGCGACAAAACTCACACATGTCCACCGTGCCCAGCACCTGAAGCAGCAG
GGGGACCGTCAGTCTTCCTCTTCCCCCCAAAACCCAAGGACACCCTCATGATCTCCCGGACC
CCTGAGGTCACATGCGTGGTGGTGAGCGTGAGCCACGAAGACCCTGAGGTCAAGTTCAACT
GGTACGTGGACGGCGTGGAGGTGCATAATGCCAAGACAAAGCCGCGGGAGGAGCAGTACA
ACAGCACGTACCGTGTGGTCAGCGTCCTCACCGTCCTGCACCAGGACTGGCTGAATGGCAAG
GAGTACAAGTGCAAGGTCTCCAACAAAGCCCTCCCAGCCCCCATCGAGAAAACCATCTCCA
AAGCCAAAGGGCAGCCCCGAGAACCACAGGTGTACGTGTACCCCCCATCCCGGGAGGAGAT
GACCAAGAACCAGGTCAGCCTGACCTGCCTGGTCAAAGGCTTCTATCCCAGCGACATCGCCG
TGGAGTGGGAGAGCAATGGGCAGCCGGAGAACAACTACAAGACCACGCCTCCCGTGCTGGA
CTCCGACGGCTCCTTCGCCCTCGTGAGCAAGCTCACCGTGGACAAGTCTAGATGGCAGCAGG
GGAACGTCTTCTCATGCTCCGTGATGCATGAGGCTCTGCACAACCACTACACGCAGAAGAGC
CTCTCCCTGTCTCCGGGTAAA

SEQ ID NO: 308 (CD3W246_HL-scFv-Fc)
GAGGTGCAGCTGGTGGAGAGCGGTGGCGGTCTGGTGAAGCCAGGTGGCAGCCTGCG
CCTGAGCTGTGCCGCCAGCGGTTTCACCTTCAGCCGCTACAACATGAACTGGGTGCGCCAAG
CCCCAGGCAAGGGCCTGGAGTGGGTGAGCAGCATCAGCACCAGCAGCAACTACATCTACTA
CGCCGACAGCGTGAAGGGCCGCTTCACCTTCAGCCGCGACAACGCCAAGAACAGCCTGGAC
CTGCAGATGAGCGGTCTGCGCGCCGAGGACACCGCCATCTACTACTGCACCCGCGGTTGGGG
CCCATTCGACTACTGGGGCCAGGGCACCCTGGTGACCGTGAGCAGCGGCGGATCTGAGGGA
AAGTCCAGCGGCTCCGGCAGCGAAAGCAAGTCCACCGGCGGAAGCGACATCCAGATGACCC
AGAGCCCAAGCAGCCTGAGCGCCAGCGTCGGCGACCGCGTGACCATCACCTGTCGTGCCCG
CCAGAGCATCGGCACCGCCATCCACTGGTACCAGCAGAAGCCAGGCAAGGCCCCAAAGCTG
CTGATCAAGTACGCCAGCGAGAGCATCAGCGGTGTGCCAAGCCGCTTCAGCGGCAGCGGCA
GCGGCACCGACTTCACCCTGACCATCAGCAGCGTGCAGCCAGAGGACTTCGCCACCTACTAC
TGCCAGCAGAGCGGCAGCTGGCCATACACCTTCGGCCAGGGCACCAAGCTGGAGATCAAGG
AGCCCAAATCTAGCGACAAAACTCACACATGTCCACCGTGCCCAGCACCTGAAGCAGCAGG
GGGACCGTCAGTCTTCCTCTTCCCCCCAAAACCCAAGGACACCCTCATGATCTCCCGGACCC
CTGAGGTCACATGCGTGGTGGTGAGCGTGAGCCACGAAGACCCTGAGGTCAAGTTCAACTG
GTACGTGGACGGCGTGGAGGTGCATAATGCCAAGACAAAGCCGCGGGAGGAGCAGTACAA
CAGCACGTACCGTGTGGTCAGCGTCCTCACCGTCCTGCACCAGGACTGGCTGAATGGCAAGG

TABLE 29-continued

| DNA SEQ ID NOs for anti-CD3 scFv and scFv-hinge-CH2-CH3 (scFv-Fc) |
|---|
| AGTACAAGTGCAAGGTCTCCAACAAAGCCCTCCCAGCCCCCATCGAGAAAACCATCTCCAA<br>AGCCAAAGGGCAGCCCCGAGAACCACAGGTGTACGTGTACCCCCCATCCCGGGAGGAGATG<br>ACCAAGAACCAGGTCAGCCTGACCTGCCTGGTCAAAGGCTTCTATCCCAGCGACATCGCCGT<br>GGAGTGGGAGAGCAATGGGCAGCCGGAGAACAACTACAAGACCACGCCTCCCGTGCTGGAC<br>TCCGACGGCTCCTTCGCCCTCGTGAGCAAGCTCACCGTGGACAAGTCTAGATGGCAGCAGGG<br>GAACGTCTTCTCATGCTCCGTGATGCATGAGGCTCTGCACAACCACTACACGCAGAAGAGCC<br>TCTCCCTGTCTCCGGGTAAA |
| SEQ ID NO: 309 (CD3W246_LH-scFv-Fc)<br>GACATCCAGATGACCCAGAGCCCAAGCAGCCTGAGCGCCAGCGTCGGCGACCGCGT<br>GACCATCACCTGTCGTGCCCGCCAGAGCATCGGCACCGCCATCCACTGGTACCAGCAGAAGC<br>CAGGCAAGGCCCCAAAGCTGCTGATCAAGTACGCCAGCGAGAGCATCAGCGGTGTGCCAAG<br>CCGCTTCAGCGGCAGCGGCAGCGGCACCGACTTCACCCTGACCATCAGCAGCGTGCAGCCA<br>GAGGACTTCGCCACCTACTACTGCCAGCAGAGCGGCAGCTGGCCATACACCTTCGGCCAGG<br>GCACCAAGCTGGAGATCAAGGGCGGATCTGAGGGAAAGTCCAGCGGCTCCGGCAGCGAAA<br>GCAAGTCCACCGGCGGAAGCGAGGTGCAGCTGGTGGAGAGCGGTGGCGGTCTGGTGAAGCC<br>AGGTGGCAGCCTGCGCCTGAGCTGTGCCGCCAGCGGTTTCACCTTCAGCCGCTACAACATGA<br>ACTGGGTGCGCCAAGCCCCAGGCAAGGGCCTGGAGTGGGTGAGCAGCATCAGCACCAGCAG<br>CAACTACATCTACTACGCCGACAGCGTGAAGGGCCGCTTCACCTTCAGCCGCGACAACGCCA<br>AGAACAGCCTGGACCTGCAGATGAGCGGTCTGCGCGCCGAGGACACCGCCATCTACTACTG<br>CACCCGCGGTTGGGGCCCATTCGACTACTGGGGCCAGGGCACCCTGGTGACCGTGAGCAGC<br>GAGCCCAAATCTAGCGACAAAACTCACACATGTCCACCGTGCCCAGCACCTGAAGCAGCAG<br>GGGGACCGTCAGTCTTCCTCTTCCCCCCAAAACCCAAGGACACCCTCATGATCTCCCGGACC<br>CCTGAGGTCACATGCGTGGTGGTGAGCGTGAGCCACGAAGACCCTGAGGTCAAGTTCAACT<br>GGTACGTGGACGGCGTGGAGGTGCATAATGCCAAGACAAAGCCGCGGGAGGAGCAGTACA<br>ACAGCACGTACCGTGTGGTCAGCGTCCTCACCGTCCTGCACCAGGACTGGCTGAATGGCAAG<br>GAGTACAAGTGCAAGGTCTCCAACAAAGCCCTCCCAGCCCCCATCGAGAAAACCATCTCCA<br>AAGCCAAAGGGCAGCCCCGAGAACCACAGGTGTACGTGTACCCCCCATCCCGGGAGGAGAT<br>GACCAAGAACCAGGTCAGCCTGACCTGCCTGGTCAAAGGCTTCTATCCCAGCGACATCGCCG<br>TGGAGTGGGAGAGCAATGGGCAGCCGGAGAACAACTACAAGACCACGCCTCCCGTGCTGGA<br>CTCCGACGGCTCCTTCGCCCTCGTGAGCAAGCTCACCGTGGACAAGTCTAGATGGCAGCAGG<br>GGAACGTCTTCTCATGCTCCGTGATGCATGAGGCTCTGCACAACCACTACACGCAGAAGAGC<br>CTCTCCCTGTCTCCGGGTAAA |
| SEQ ID NO: 310 (CD3W247_HL-scFv-Fc)<br>GAGGTGCAGCTGGTGGAGAGCGGTGGCGGTCTGGTGAAGCCAGGTGGCAGCCTGCG<br>CCTGAGCTGTGCCGCCAGCGGTTTCACCTTCAGCCGCTACAACATGAACTGGGTGCGCCAAG<br>CCCCAGGCAAGGGCCTGGAGTGGGTGAGCAGCATCAGCACCAGCAGCAACTACATCTACTA<br>CGCCGACAGCGTGAAGGGCCGCTTCACCTTCAGCCGCGACAACGCCAAGAACAGCCTGGAC<br>CTGCAGATGAGCGGTCTGCGCGCCGAGGACACCGCCATCTACTACTGCACCCGCGGTTGGGG<br>CCCATTCGACTACTGGGGCCAGGGCACCCTGGTGACCGTGAGCAGCGGCGGATCTGAGGGA<br>AAGTCCAGCGGCTCCGGCAGCGAAAGCAAGTCCACCGGCGGAAGCGACATCCAGATGACCC<br>AGAGCCCAAGCAGCCTGAGCGCCAGCGTCGGCGACCGCGTGACCATCACCTGTCGTGCCCG<br>CCAGAGCATCGGCACCGCCATCCACTGGTACCAGCAGAAGCCAGGCAAGGCCCCAAAGCTG<br>CTGATCTACTACGCCAGCGAGAGCATCAGCGGTGTGCCAAGCCGCTTCAGCGGCAGCGGCA<br>GCGGCACCGACTTCACCCTGACCATCAGCAGCCTGCAGCCAGAGGACTTCGCCACCTACTAC<br>TGCCAGCAGAGCGGCAGCTGGCCATACACCTTCGGCCAGGGCACCAAGCTGGAGATCAAGG<br>AGCCCAAATCTAGCGACAAAACTCACACATGTCCACCGTGCCCAGCACCTGAAGCAGCAGG<br>GGGACCGTCAGTCTTCCTCTTCCCCCCAAAACCCAAGGACACCCTCATGATCTCCCGGACCC<br>CTGAGGTCACATGCGTGGTGGTGAGCGTGAGCCACGAAGACCCTGAGGTCAAGTTCAACTG<br>GTACGTGGACGGCGTGGAGGTGCATAATGCCAAGACAAAGCCGCGGGAGGAGCAGTACAA<br>CAGCACGTACCGTGTGGTCAGCGTCCTCACCGTCCTGCACCAGGACTGGCTGAATGGCAAGG<br>AGTACAAGTGCAAGGTCTCCAACAAAGCCCTCCCAGCCCCCATCGAGAAAACCATCTCCAA<br>AGCCAAAGGGCAGCCCCGAGAACCACAGGTGTACGTGTACCCCCCATCCCGGGAGGAGATG<br>ACCAAGAACCAGGTCAGCCTGACCTGCCTGGTCAAAGGCTTCTATCCCAGCGACATCGCCGT<br>GGAGTGGGAGAGCAATGGGCAGCCGGAGAACAACTACAAGACCACGCCTCCCGTGCTGGAC<br>TCCGACGGCTCCTTCGCCCTCGTGAGCAAGCTCACCGTGGACAAGTCTAGATGGCAGCAGGG<br>GAACGTCTTCTCATGCTCCGTGATGCATGAGGCTCTGCACAACCACTACACGCAGAAGAGCC<br>TCTCCCTGTCTCCGGGTAAA |
| SEQ ID NO: 311 (CD3W247_LH-scFv-Fc)<br>GACATCCAGATGACCCAGAGCCCAAGCAGCCTGAGCGCCAGCGTCGGCGACCGCGT<br>GACCATCACCTGTCGTGCCCGCCAGAGCATCGGCACCGCCATCCACTGGTACCAGCAGAAGC<br>CAGGCAAGGCCCCAAAGCTGCTGATCTACTACGCCAGCGAGAGCATCAGCGGTGTGCCAAG<br>CCGCTTCAGCGGCAGCGGCAGCGGCACCGACTTCACCCTGACCATCAGCAGCCTGCAGCCA<br>GAGGACTTCGCCACCTACTACTGCCAGCAGAGCGGCAGCTGGCCATACACCTTCGGCCAGG<br>GCACCAAGCTGGAGATCAAGGGCGGATCTGAGGGAAAGTCCAGCGGCTCCGGCAGCGAAA<br>GCAAGTCCACCGGCGGAAGCGAGGTGCAGCTGGTGGAGAGCGGTGGCGGTCTGGTGAAGCC<br>AGGTGGCAGCCTGCGCCTGAGCTGTGCCGCCAGCGGTTTCACCTTCAGCCGCTACAACATGA<br>ACTGGGTGCGCCAAGCCCCAGGCAAGGGCCTGGAGTGGGTGAGCAGCATCAGCACCAGCAG<br>CAACTACATCTACTACGCCGACAGCGTGAAGGGCCGCTTCACCTTCAGCCGCGACAACGCCA<br>AGAACAGCCTGGACCTGCAGATGAGCGGTCTGCGCGCCGAGGACACCGCCATCTACTACTG<br>CACCCGCGGTTGGGGCCCATTCGACTACTGGGGCCAGGGCACCCTGGTGACCGTGAGCAGC<br>GAGCCCAAATCTAGCGACAAAACTCACACATGTCCACCGTGCCCAGCACCTGAAGCAGCAG<br>GGGGACCGTCAGTCTTCCTCTTCCCCCCAAAACCCAAGGACACCCTCATGATCTCCCGGACC<br>CCTGAGGTCACATGCGTGGTGGTGAGCGTGAGCCACGAAGACCCTGAGGTCAAGTTCAACT<br>GGTACGTGGACGGCGTGGAGGTGCATAATGCCAAGACAAAGCCGCGGGAGGAGCAGTACA |

TABLE 29-continued

| DNA SEQ ID NOs for anti-CD3 scFv and scFv-hinge-CH2-CH3 (scFv-Fc) |
|---|
| ACAGCACGTACCGTGTGGTCAGCGTCCTCACCGTCCTGCACCAGGACTGGCTGAATGGCAAG<br>GAGTACAAGTGCAAGGTCTCCAACAAAGCCCTCCCAGCCCCCATCGAGAAAACCATCTCCA<br>AAGCCAAAGGGCAGCCCCGAGAACCACAGGTGTACGTGTACCCCCCATCCCGGGAGGAGAT<br>GACCAAGAACCAGGTCAGCCTGACCTGCCTGGTCAAAGGCTTCTATCCCAGCGACATCGCCG<br>TGGAGTGGGAGAGCAATGGGCAGCCGGAGAACAACTACAAGACCACGCCTCCCGTGCTGGA<br>CTCCGACGGCTCCTTCGCCCTCGTGAGCAAGCTCACCGTGGACAAGTCTAGATGGCAGCAGG<br>GGAACGTCTTCTCATGCTCCGTGATGCATGAGGCTCTGCACAACCACTACACGCAGAAGAGC<br>CTCTCCCTGTCTCCGGGTAAA |
| SEQ ID NO: 312 (CD3W248_HL-scFv-Fc)<br>GAGGTGCAACTGGTGGAGTCTGGGGGAGGCCTGGTCAAGCCTGGGGGGTCCCTGAG<br>ACTCTCCTGTGCAGCCTCTGGATTCACCTTCAGTAGATATAACATGAACTGGGTCCGCCAGG<br>CTCCAGGGAAGGGGCTGGAGTGGGTCTCATCCATTAGTACTAGTAGTAATTACATATACTAC<br>GCAGACTCAGTGAAGGGCCGATTCACCTTCTCCAGAGACAACGCCAAGAACTCACTGGATCT<br>GCAAATGAGCGGCCTGAGAGCCGAGGACACGGCTATTTATTACTGTACGAGAGGCTGGGGG<br>CCTTTTGACTACTGGGGCCAGGGAACCCTGGTCACCGTCTCCTCAGGCGGATCTGAGGGAAA<br>GTCCAGCGGCTCCGGCAGCGAAAGCAAGTCCACCGGCGGAAGCGACATCTTGCTGACTCAG<br>TCTCCAGGCATCCTGTCTGTGAGTCCAGGAGAAAGAGTCAGTTTCTCCTGCAGGGCCAGACA<br>GAGCATTGGCACAGCCATACACTGGTATCAGCAAAGAACAAATGGTTCTCCAAGGCTTCTCA<br>TAAAGTATGCTTCTGAGTCTATCTCTGGGATCCCTTCCAGGTTTAGCGGCAGTGGATCAGGG<br>ACAGATTTTACTCTTACCATCAACAGTGTGGAGTCTGAAGATATTGCAGATTATTACTGTCA<br>ACAAAGTGGGAGCTGGCCGTACACGTTCGGAGGGGGGACCAAGCTGGAAATAAAAGAGCC<br>CAAATCTAGCGACAAAACTCACACATGTCCACCGTGCCCAGCACCTGAAGCAGCAGGGGGA<br>CCGTCAGTCTTCCTCTTCCCCCCAAAACCCAAGGACACCCTCATGATCTCCCGGACCCCTGA<br>GGTCACATGCGTGGTGGTGAGCGTGAGCCACGAAGACCCTGAGGTCAAGTTCAACTGGTAC<br>GTGGACGGCGTGGAGGTGCATAATGCCAAGACAAAGCCGCGGGAGGAGCAGTACAACAGC<br>ACGTACCGTGTGGTCAGCGTCCTCACCGTCCTGCACCAGGACTGGCTGAATGGCAAGGAGTA<br>CAAGTGCAAGGTCTCCAACAAAGCCCTCCCAGCCCCCATCGAGAAAACCATCTCCAAAGCC<br>AAAGGGCAGCCCCGAGAACCACAGGTGTACGTGTACCCCCCATCCCGGGAGGAGATGACCA<br>AGAACCAGGTCAGCCTGACCTGCCTGGTCAAAGGCTTCTATCCCAGCGACATCGCCGTGGAG<br>TGGGAGAGCAATGGGCAGCCGGAGAACAACTACAAGACCACGCCTCCCGTGCTGGACTCCG<br>ACGGCTCCTTCGCCCTCGTGAGCAAGCTCACCGTGGACAAGTCTAGATGGCAGCAGGGGAA<br>CGTCTTCTCATGCTCCGTGATGCATGAGGCTCTGCACAACCACTACACGCAGAAGAGCCTCT<br>CCCTGTCTCCGGGTAAA |
| SEQ ID NO: 313 (CD3W248_LH-scFv-Fc)<br>GACATCTTGCTGACTCAGTCTCCAGGCATCCTGTCTGTGAGTCCAGGAGAAAGAGTC<br>AGTTTCTCCTGCAGGGCCAGACAGAGCATTGGCACAGCCATACACTGGTATCAGCAAAGAA<br>CAAATGGTTCTCCAAGGCTTCTCATAAAGTATGCTTCTGAGTCTATCTCTGGGATCCCTTCCA<br>GGTTTAGCGGCAGTGGATCAGGGACAGATTTTACTCTTACCATCAACAGTGTGGAGTCTGAA<br>GATATTGCAGATTATTACTGTCAACAAAGTGGGAGCTGGCCGTACACGTTCGGAGGGGGGA<br>CCAAGCTGGAAATAAAAGGCGGATCTGAGGGAAAGTCCAGCGGCTCCGGCAGCGAAAGCA<br>AGTCCACCGGCGGAAGCGAGGTGCAACTGGTGGAGTCTGGGGGAGGCCTGGTCAAGCCTGG<br>GGGGTCCCTGAGACTCTCCTGTGCAGCCTCTGGATTCACCTTCAGTAGATATAACATGAACT<br>GGGTCCGCCAGGCTCCAGGGAAGGGGCTGGAGTGGGTCTCATCCATTAGTACTAGTAGTAAT<br>TACATATACTACGCAGACTCAGTGAAGGGCCGATTCACCTTCTCCAGAGACAACGCCAAGA<br>ACTCACTGGATCTGCAAATGAGCGGCCTGAGAGCCGAGGACACGGCTATTTATTACTGTACG<br>AGAGGCTGGGGGCCTTTTGACTACTGGGGCCAGGGAACCCTGGTCACCGTCTCCTCAGAGCC<br>CAAATCTAGCGACAAAACTCACACATGTCCACCGTGCCCAGCACCTGAAGCAGCAGGGGGA<br>CCGTCAGTCTTCCTCTTCCCCCCAAAACCCAAGGACACCCTCATGATCTCCCGGACCCCTGA<br>GGTCACATGCGTGGTGGTGAGCGTGAGCCACGAAGACCCTGAGGTCAAGTTCAACTGGTAC<br>GTGGACGGCGTGGAGGTGCATAATGCCAAGACAAAGCCGCGGGAGGAGCAGTACAACAGC<br>ACGTACCGTGTGGTCAGCGTCCTCACCGTCCTGCACCAGGACTGGCTGAATGGCAAGGAGTA<br>CAAGTGCAAGGTCTCCAACAAAGCCCTCCCAGCCCCCATCGAGAAAACCATCTCCAAAGCC<br>AAAGGGCAGCCCCGAGAACCACAGGTGTACGTGTACCCCCCATCCCGGGAGGAGATGACCA<br>AGAACCAGGTCAGCCTGACCTGCCTGGTCAAAGGCTTCTATCCCAGCGACATCGCCGTGGAG<br>TGGGAGAGCAATGGGCAGCCGGAGAACAACTACAAGACCACGCCTCCCGTGCTGGACTCCG<br>ACGGCTCCTTCGCCCTCGTGAGCAAGCTCACCGTGGACAAGTCTAGATGGCAGCAGGGGAA<br>CGTCTTCTCATGCTCCGTGATGCATGAGGCTCTGCACAACCACTACACGCAGAAGAGCCTCT<br>CCCTGTCTCCGGGTAAA |

Engineering of CD3 Fabs for hK2/CD3 Bispecific Generation

The CD3 specific VH and VL regions were engineered in VH-CH1-linker-CH2-CH3 and VL-CL formats respectively and expressed as IgG1. The polypeptide of SEQ ID NO: 314 comprising the Fc silencing mutation L234A/L235A/D265S and the CH3 mutation T350V/L351Y/F405A/Y407V designed to promote selective heterodimerization was used to generate the CD3 specific VH-CH1-linker-CH2-CH3 (Table 30). The VH-CH1-linker-CH2-CH3 heavy chains were engineered either having or lacking the C-terminal Lysin in the CH3 domain. The VH-CH1-linker-CH2-CH3 heavy chain lacking the C-terminal Lysin is shown in SEQ ID NO: 85.

(huIgG1_G1m(17)_AAS_ZWA)

SEQ ID NO: 314

ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKKV

EPKSCDKTHTCPPCPAPEAAGGPSVFLFPPKPKDTLMISRTPEVTCVVV

SVSHEDPEVKFNWYVDGVEVHNAKTKPREEQYNSTYRVVSVLTVLHQDW

-continued

LNGKEYKCKVSNKALPAPIEKTISKAKGQPREPQVYVYPPSREEMTKNQ

VSLTCLVKGFYPSDIAVEWESNGQPENNYKTTPPVLDSDGSFALVSKLT

VDKSRWQQGNVFSCSVMHEALHNHYTQKSLSLSPGK

The polypeptides of SEQ ID NO: 363 or 364 were used to generate the CD3 specific VL-CL (Table 31)

(human kappa light chain)

SEQ ID NO: 363

RTVAAPSVFIFPPSDEQLKSGTASVVCLLNNFYPREAKVQWKVDNALQS

GNSQESVTEQDSKDSTYSLSSTLTLSKADYEKHKVYACEVTHQGLSSPV

TKSFNRGEC (human lambda light chain)

SEQ ID NO: 364

GQPKAAPSVTLFPPSSEELQANKATLVCLISDFYPGAVTVAWKADSSPV

KAGVETTTPSKQSNNKYAASSYLSLTPEQWKSHRSYSCQVTHEGSTVEK

TVAPTECS

DNA sequences of anti-CD3 molecules as HC in VH-CH1-liker-CH2-CH3 format and LC in VL-CL format are shown in Table 32.

TABLE 30

Amino acid sequence of the anti-CD3 antibody arm VH-CH1-linker-CH2-CH3 of the bi-specific antibody.

| HC protein | SEQ ID NO: | HC amino acid sequence |
|---|---|---|
| CD3W244 HC,<br>CD3W245 HC,<br>CD3W246 HC,<br>CD3W247 HC,<br>CD3W248 HC, | 719 | EVQLVESGGGLVKPGGSLRLSCAASGFTFSRYNMNWVRQAPGKG<br>LEWVSSISTSSNYIYYADSVKGRFTFSRDNAKNSLDLQMSGLRAE<br>DTAIYYCTRGWGPFDYWGQGTLVTVSSASTKGPSVFPLAPSSKST<br>SGGTAALGCLVKDYFPEPVTVSWNSGALTSGVHTFPAVLQSSGL<br>YSLSSVVTVPSSSLGTQTYICNVNHKPSNTKVDKKVEPKSCDKTH<br>TCPPCPAPEAAGGPSVFLFPPKPKDTLMISRTPEVTCVVVSVSHED<br>PEVKFNWYVDGVEVHNAKTKPREEQYNSTYRVVSVLTVLHQDW<br>LNGKEYKCKVSNKALPAPIEKTISKAKGQPREPQVYVYPPSREEM<br>TKNQVSLTCLVKGFYPSDIAVEWESNGQPENNYKTTPPVLDSDGS<br>FALVSKLTVDKSRWQQGNVFSCSVMHEALHNHYTQKSLSLSPGK |
| CD3B376 HC | 349 | QVQLQQSGPRLVRPSQTLSLTCAISGDSVFNNNAAWSWIRQSPSR<br>GLEWLGRTYYRSKWLYDYAVSVKSRITVNPDTSRNQFTLQLNSV<br>TPEDTALYYCARGYSSSFDYWGQGTLVTVSSASTKGPSVFPLAPS<br>SKSTSGGTAALGCLVKDYFPEPVTVSWNSGALTSGVHTFPAVLQS<br>SGLYSLSSVVTVPSSSLGTQTYICNVNHKPSNTKVDKKVEPKSCD<br>KTHTCPPCPAPEAAGGPSVFLFPPKPKDTLMISRTPEVTCVVVSVS<br>HEDPEVKFNWYVDGVEVHNAKTKPREEQYNSTYRVVSVLTVLH<br>QDWLNGKEYKCKVSNKALPAPIEKTISKAKGQPREPQVYVYPPSR<br>EEMTKNQVSLTCLVKGFYPSDIAVEWESNGQPENNYKTTPPVLDS<br>DGSFALVSKLTVDKSRWQQGNVFSCSVMHEALHNHYTQKSLSLS<br>PG |

TABLE 31

Amino acid sequence of the anti-CD3 antibody light chain arm (VL-CL) of the bi-specific antibody

| LC protein | SEQ ID NO: | LC amino acid sequence |
|---|---|---|
| CD3W244 LC | 86 | DIQMTQSPSSLSASVGDRVTITCRARQSIGTAIHWYQQKPGKAPKLL<br>IYYASESISGVPSRFSGSGSGTDFTLTISSVQPEDFATYYCQQSGSWP<br>YTFGQGTKLEIKRTVAAPSVFIFPPSDEQLKSGTASVVCLLNNFYPRE<br>AKVQWKVDNALQSGNSQESVTEQDSKDSTYSLSSTLTLSKADYEK<br>HKVYACEVTHQGLSSPVTKSFNRGEC |

TABLE 31-continued

Amino acid sequence of the anti-CD3 antibody light chain arm (VL-CL) of the bi-specific antibody

| LC protein | SEQ ID NO: | LC amino acid sequence |
|---|---|---|
| CD3W245 LC | 88 | DIQMTQSPSSLSASVGDRVTITCRARQSIGTAIHWYQQKPGKAPKLL<br>IKYASESISGVPSRFSGSGSGTDFTLTISSLQPEDFATYYCQQSGSWP<br>YTFGQGTKLEIKRTVAAPSVFIFPPSDEQLKSGTASVVCLLNNFYPRE<br>AKVQWKVDNALQSGNSQESVTEQDSKDSTYSLSSTLTLSKADYEK<br>HKVYACEVTHQGLSSPVTKSFNRGEC |
| CD3W246 LC | 90 | DIQMTQSPSSLSASVGDRVTITCRARQSIGTAIHWYQQKPGKAPKLL<br>IKYASESISGVPSRFSGSGSGTDFTLTISSVQPEDFATYYCQQSGSWP<br>YTFGQGTKLEIKRTVAAPSVFIFPPSDEQLKSGTASVVCLLNNFYPRE<br>AKVQWKVDNALQSGNSQESVTEQDSKDSTYSLSSTLTLSKADYEK<br>HKVYACEVTHQGLSSPVTKSFNRGEC |
| CD3W247 LC | 92 | DIQMTQSPSSLSASVGDRVTITCRARQSIGTAIHWYQQKPGKAPKLL<br>IYYASESISGVPSRFSGSGSGTDFTLTISSLQPEDFATYYCQQSGSWP<br>YTFGQGTKLEIKRTVAAPSVFIFPPSDEQLKSGTASVVCLLNNFYPRE<br>AKVQWKVDNALQSGNSQESVTEQDSKDSTYSLSSTLTLSKADYEK<br>HKVYACEVTHQGLSSPVTKSFNRGEC |
| CD3W248 LC | 94 | DILLTQSPGILSVSPGERVSFSCRARQSIGTAIHWYQQRTNGSPRLLIK<br>YASESISGIPSRFSGSGSGTDFTLTINSVESEDIADYYCQQSGSWPYTF<br>GGGTKLEIKRTVAAPSVFIFPPSDEQLKSGTASVVCLLNNFYPREAK<br>VQWKVDNALQSGNSQESVTEQDSKDSTYSLSSTLTLSKADYEKHK<br>VYACEVTHQGLSSPVTKSFNRGEC |
| CD3B376 LC | 350 | QSALTQPASVSGSPGQSITISCTGTSSNIGTYKFVSWYQQHPDKAPK<br>VLLYEVSKRPSGVSSRFSGSKSGNTASLTISGLQAEDQADYHCVSYA<br>GSGTLLFGGGTKLTVLGQPKAAPSVTLFPPSSEELQANKATLVCLIS<br>DFYPGAVTVAWKADSSPVKAGVETTTPSKQSNNKYAASSYLSLTPE<br>QWKSHRSYSCQVTHEGSTVEKTVAPTECS |

TABLE 32 cDNA SEQ ID NOs of anti-CD3 arms of bi-specific antibodies HC in VH-CH1-liker-CH2-CH3 format and LC in VL-CL format.

| Antibody | HC cDNA SEQ ID NO: | LC cDNA SEQ ID NO: |
|---|---|---|
| CD3W244 | 315 | 316 |
| CD3W245 | 315 | 317 |
| CD3W246 | 315 | 318 |
| CD3W247 | 315 | 319 |
| CD3W248 | 315 | 320 |
| CD3B376 | 351 | 352 |

(CD3W244, CDRW245, CD3W246, CD3W247, CD3W248 HC cDNA)

SEQ ID NO: 315

GAGGTGCAGCTGGTGGAGAGCGGTGGCGGTCTGGTGAAGCCAGGTGGCAGCCTGCGCCTGA
GCTGTGCCGCCAGCGGTTTCACCTTCAGCCGCTACAACATGAACTGGGTGCGCCAAGCCCCA
GGCAAGGGCCTGGAGTGGGTGAGCAGCATCAGCACCAGCAGCAACTACATCTACTACGCCG
ACAGCGTGAAGGGCCGCTTCACCTTCAGCCGCGACAACGCCAAGAACAGCCTGGACCTGCA
GATGAGCGGTCTGCGCGCCGAGGACACCGCCATCTACTACTGCACCCGCGGTTGGGGCCCAT
TCGACTACTGGGGCCAGGGCACCCTGGTGACCGTGAGCAGCGCCTCCACCAAGGGCCCATC
GGTCTTCCCCCTGGCACCCTCCTCCAAGAGCACCTCTGGGGGCACAGCGGCCCTGGGCTGCC
TGGTCAAGGACTACTTCCCCGAACCGGTGACGGTGTCGTGGAACTCAGGCGCCCTGACCAGC
GGCGTGCACACCTTCCCGGCTGTCCTACAGTCCTCAGGACTCTACTCCCTCAGCAGCGTGGT
GACCGTGCCCTCCAGCAGCTTGGGCACCCAGACCTACATCTGCAACGTGAATCACAAGCCCA
GCAACACCAAGGTGGACAAGAAAGTTGAGCCCAAATCTTGTGACAAAACTCACACATGTCC
ACCGTGCCCAGCACCTGAAGCAGCAGGGGGACCGTCAGTCTTCCTCTTCCCCCCAAAACCCA
AGGACACCCTCATGATCTCCCGGACCCCTGAGGTCACATGCGTGGTGGTGAGCGTGAGCCAC
GAAGACCCTGAGGTCAAGTTCAACTGGTACGTGGACGGCGTGGAGGTGCATAATGCCAAGA
CAAAGCCGCGGGAGGAGCAGTACAACAGCACGTACCGTGTGGTCAGCGTCCTCACCGTCCT
GCACCAGGACTGGCTGAATGGCAAGGAGTACAAGTGCAAGGTCTCCAACAAAGCCCTCCCA
GCCCCCATCGAGAAAACCATCTCCAAAGCCAAAGGGCAGCCCCGAGAACCACAGGTGTACG
TGTACCCCCCATCCCGGGAGGAGATGACCAAGAACCAGGTCAGCCTGACCTGCCTGGTCAA

TABLE 32-continued

| cDNA SEQ ID NOs of anti-CD3 arms of bi-specific antibodies HC in VH-CH1-liker-CH2-CH3 format and LC in VL-CL format. |
|---|
| AGGCTTCTATCCCAGCGACATCGCCGTGGAGTGGGAGAGCAATGGGCAGCCGGAGAACAAC<br>TACAAGACCACGCCTCCCGTGCTGGACTCCGACGGCTCCTTCGCCCTCGTGAGCAAGCTCAC<br>CGTGGACAAGTCTAGATGGCAGCAGGGGAACGTCTTCTCATGCTCCGTGATGCATGAGGCTC<br>TGCACAACCACTACACGCAGAAGAGCCTCTCCCTGTCTCCGGGTAAA |
| (CD3W244 LC cDNA)<br>SEQ ID NO: 316<br>GACATCCAGATGACCCAGAGCCCAAGCAGCCTGAGCGCCAGCGTCGGCGACCGCGTGACCA<br>TCACCTGTCGTGCCCGCCAGAGCATCGGCACCGCCATCCACTGGTACCAGCAGAAGCCAGGC<br>AAGGCCCCAAAGCTGCTGATCTACTACGCCAGCGAGAGCATCAGCGGTGTGCCAAGCCGCT<br>TCAGCGGCAGCGGCAGCGGCACCGACTTCACCCTGACCATCAGCAGCGTGCAGCCAGAGGA<br>CTTCGCCACCTACTACTGCCAGCAGAGCGGCAGCTGGCCATACACCTTCGGCCAGGGCACCA<br>AGCTGGAGATCAAGCGTACGGTGGCTGCACCATCTGTCTTCATCTTCCCGCCATCTGATGAG<br>CAGTTGAAATCTGGAACTGCCTCTGTTGTGTGCCTGCTGAATAACTTCTATCCCAGAGAGGC<br>CAAAGTACAGTGGAAGGTGGATAACGCCCTCCAATCGGGTAACTCCCAGGAGAGTGTCACA<br>GAGCAGGACAGCAAGGACAGCACCTACAGCCTCAGCAGCACCCTGACGCTGAGCAAAGCAG<br>ACTACGAGAAACACAAAGTCTACGCCTGCGAAGTCACCCATCAGGGCCTGAGCTCGCCCGT<br>CACAAAGAGCTTCAACAGGGGAGAGTGT |
| (CD3W245 LC cDNA)<br>SEQ ID NO: 317<br>GACATCCAGATGACCCAGAGCCCAAGCAGCCTGAGCGCCAGCGTCGGCGACCGCGTGACCA<br>TCACCTGTCGTGCCCGCCAGAGCATCGGCACCGCCATCCACTGGTACCAGCAGAAGCCAGGC<br>AAGGCCCCAAAGCTGCTGATCAAGTACGCCAGCGAGAGCATCAGCGGTGTGCCAAGCCGCT<br>TCAGCGGCAGCGGCAGCGGCACCGACTTCACCCTGACCATCAGCAGCCTGCAGCCAGAGGA<br>CTTCGCCACCTACTACTGCCAGCAGAGCGGCAGCTGGCCATACACCTTCGGCCAGGGCACCA<br>AGCTGGAGATCAAGCGTACGGTGGCTGCACCATCTGTCTTCATCTTCCCGCCATCTGATGAG<br>CAGTTGAAATCTGGAACTGCCTCTGTTGTGTGCCTGCTGAATAACTTCTATCCCAGAGAGGC<br>CAAAGTACAGTGGAAGGTGGATAACGCCCTCCAATCGGGTAACTCCCAGGAGAGTGTCACA<br>GAGCAGGACAGCAAGGACAGCACCTACAGCCTCAGCAGCACCCTGACGCTGAGCAAAGCAG<br>ACTACGAGAAACACAAAGTCTACGCCTGCGAAGTCACCCATCAGGGCCTGAGCTCGCCCGT<br>CACAAAGAGCTTCAACAGGGGAGAGTGT |
| (CD3W246 LC cDNA)<br>SEQ ID NO: 318<br>GACATCCAGATGACCCAGAGCCCAAGCAGCCTGAGCGCCAGCGTCGGCGACCGCGTGACCA<br>TCACCTGTCGTGCCCGCCAGAGCATCGGCACCGCCATCCACTGGTACCAGCAGAAGCCAGGC<br>AAGGCCCCAAAGCTGCTGATCAAGTACGCCAGCGAGAGCATCAGCGGTGTGCCAAGCCGCT<br>TCAGCGGCAGCGGCAGCGGCACCGACTTCACCCTGACCATCAGCAGCGTGCAGCCAGAGGA<br>CTTCGCCACCTACTACTGCCAGCAGAGCGGCAGCTGGCCATACACCTTCGGCCAGGGCACCA<br>AGCTGGAGATCAAGCGTACGGTGGCTGCACCATCTGTCTTCATCTTCCCGCCATCTGATGAG<br>CAGTTGAAATCTGGAACTGCCTCTGTTGTGTGCCTGCTGAATAACTTCTATCCCAGAGAGGC<br>CAAAGTACAGTGGAAGGTGGATAACGCCCTCCAATCGGGTAACTCCCAGGAGAGTGTCACA<br>GAGCAGGACAGCAAGGACAGCACCTACAGCCTCAGCAGCACCCTGACGCTGAGCAAAGCAG<br>ACTACGAGAAACACAAAGTCTACGCCTGCGAAGTCACCCATCAGGGCCTGAGCTCGCCCGT<br>CACAAAGAGCTTCAACAGGGGAGAGTGT |
| (CD3W247 LC cDNA)<br>SEQ ID NO: 319<br>GACATCCAGATGACCCAGAGCCCAAGCAGCCTGAGCGCCAGCGTCGGCGACCGCGTGACCA<br>TCACCTGTCGTGCCCGCCAGAGCATCGGCACCGCCATCCACTGGTACCAGCAGAAGCCAGGC<br>AAGGCCCCAAAGCTGCTGATCTACTACGCCAGCGAGAGCATCAGCGGTGTGCCAAGCCGCT<br>TCAGCGGCAGCGGCAGCGGCACCGACTTCACCCTGACCATCAGCAGCCTGCAGCCAGAGGA<br>CTTCGCCACCTACTACTGCCAGCAGAGCGGCAGCTGGCCATACACCTTCGGCCAGGGCACCA<br>AGCTGGAGATCAAGCGTACGGTGGCTGCACCATCTGTCTTCATCTTCCCGCCATCTGATGAG<br>CAGTTGAAATCTGGAACTGCCTCTGTTGTGTGCCTGCTGAATAACTTCTATCCCAGAGAGGC<br>CAAAGTACAGTGGAAGGTGGATAACGCCCTCCAATCGGGTAACTCCCAGGAGAGTGTCACA<br>GAGCAGGACAGCAAGGACAGCACCTACAGCCTCAGCAGCACCCTGACGCTGAGCAAAGCAG<br>ACTACGAGAAACACAAAGTCTACGCCTGCGAAGTCACCCATCAGGGCCTGAGCTCGCCCGT<br>CACAAAGAGCTTCAACAGGGGAGAGTGT |
| (CD3W248 LC cDNA)<br>SEQ ID NO: 320<br>GACATCTTGCTGACTCAGTCTCCAGGCATCCTGTCTGTGAGTCCAGGAGAAAGAGTCAGTTT<br>CTCCTGCAGGGCCAGACAGAGCATTGGCACAGCCATACACTGGTATCAGCAAAGAACAAAT<br>GGTTCTCCAAGGCTTCTCATAAAGTATGCTTCTGAGTCTATCTCTGGGATCCCTTCCAGGTTT<br>AGCGGCAGTGGATCAGGGACAGATTTTACTCTTACCATCAACAGTGTGGAGTCTGAAGATAT<br>TGCAGATTATTACTGTCAACAAAGTGGGAGCTGGCCGTACACGTTCGGAGGGGGGACCAAG<br>CTGGAAATAAAACGTACGGTGGCTGCACCATCTGTCTTCATCTTCCCGCCATCTGATGAGCA<br>GTTGAAATCTGGAACTGCCTCTGTTGTGTGCCTGCTGAATAACTTCTATCCCAGAGAGGCCA<br>AAGTACAGTGGAAGGTGGATAACGCCCTCCAATCGGGTAACTCCCAGGAGAGTGTCACAGA<br>GCAGGACAGCAAGGACAGCACCTACAGCCTCAGCAGCACCCTGACGCTGAGCAAAGCAGAC<br>TACGAGAAACACAAAGTCTACGCCTGCGAAGTCACCCATCAGGGCCTGAGCTCGCCCGTCA<br>CAAAGAGCTTCAACAGGGGAGAGTGT |

TABLE 32-continued cDNA SEQ ID NOs of anti-CD3 arms of bi-specific antibodies HC in VH-CH1-liker-CH2-CH3 format and LC in VL-CL format.

(CD3B376 HC)

SEQ ID NO: 351

CAGGTGCAGCTCCAACAGAGTGGTCCCAGACTCGTGAGACCCTCTCAAACACTCAGTTTGAC
TTGTGCCATCTCAGGCGATTCAGTTTTCAACAACAATGCAGCTTGGAGCTGGATTAGGCAGT
CACCTAGTCGCGGTCTTGAATGGCTTGGGCGTACATACTATCGCTCTAAATGGTTGTATGATT
ACGCTGTGTCCGTGAAGAGCCGAATCACCGTAAACCCTGATACCTCCAGGAATCAGTTCACA
TTGCAACTGAATAGTGTGACTCCCGAGGATACTGCACTCTATTATTGTGCCCGAGGATATAG
CAGTAGCTTCGACTATTGGGGACAAGGGACACTCGTTACCGTTAGTTCAGCCTCCACCAAGG
GCCCATCGGTCTTCCCCCTGGCACCCTCCTCCAAGAGCACCTCTGGGGGCACAGCGGCCCTG
GGCTGCCTGGTCAAGGACTACTTCCCCGAACCGGTGACGGTGTCGTGGAACTCAGGCGCCCT
GACCAGCGGCGTGCACACCTTCCCGGCTGTCCTACAGTCCTCAGGACTCTACTCCCTCAGCA
GCGTGGTGACCGTGCCCTCCAGCAGCTTGGGCACCCAGACCTACATCTGCAACGTGAATCAC
AAGCCCAGCAACACCAAGGTGGACAAGAAAGTTGAGCCCAAATCTTGTGACAAAACTCACA
CATGTCCACCGTGCCCAGCACCTGAAGCAGCAGGGGGACCGTCAGTCTTCCTCTTCCCCCCA
AAACCCAAGGACACCCTCATGATCTCCCGGACCCCTGAGGTCACATGCGTGGTGGTGAGCGT
GAGCCACGAAGACCCTGAGGTCAAGTTCAACTGGTACGTGGACGGCGTGGAGGTGCATAAT
GCCAAGACAAAGCCGCGGGAGGAGCAGTACAACAGCACGTACCGTGTGGTCAGCGTCCTCA
CCGTCCTGCACCAGGACTGGCTGAATGGCAAGGAGTACAAGTGCAAGGTCTCCAACAAAGC
CCTCCCAGCCCCCATCGAGAAAACCATCTCCAAAGCCAAAGGGCAGCCCCGAGAACCACAG
GTGTACGTGTACCCCCCATCCCGGGAGGAGATGACCAAGAACCAGGTCAGCCTGACCTGCCT
GGTCAAAGGCTTCTATCCCAGCGACATCGCCGTGGAGTGGGAGAGCAATGGGCAGCCGGAG
AACAACTACAAGACCACGCCTCCCGTGCTGGACTCCGACGGCTCCTTCGCCCTCGTGAGCAA
GCTCACCGTGGACAAGTCTAGATGGCAGCAGGGGAACGTCTTCTCATGCTCCGTGATGCATG
AGGCTCTGCACAACCACTACACGCAGAAGAGCCTCTCCCTGTCTCCGGGT (CD3B376 LC)

SEQ ID NO: 352

CAGTCTGCTCTGACCCAGCCTGCCTCCGTGTCTGGCTCTCCCGGCCAGTCCATCACCATCAGC
TGTACCGGCACCTCCTCCAACATCGGCACCTACAAGTTCGTGTCCTGGTATCAGCAGCACCC
CGACAAGGCCCCCAAAGTGCTGCTGTACGAGGTGTCCAAGCGGCCCTCTGGCGTGTCCTCCA
GATTCTCCGGCTCCAAGTCTGGCAACACCGCCTCCCTGACCATCAGCGGACTGCAGGCTGAG
GACCAGGCCGACTACCACTGTGTGTCCTACGCTGGCTCTGGCACCCTGCTGTTTGGCGGAGG
CACCAAGCTGACCGTGCTGGGTCAGCCCAAGGCTGCACCCAGTGTCACTCTGTTCCCGCCCT
CCTCTGAGGAGCTTCAAGCCAACAAGGCCACACTGGTGTGTCTCATAAGTGACTTCTACCCG
GGAGCCGTGACAGTGGCCTGGAAGGCCGATAGCAGCCCCGTCAAGGCGGGAGTGGAGACCA
CCACACCCTCCAAACAAAGCAACAACAAGTACGCGGCCAGCAGCTATCTGAGCCTGACGCC
TGAGCAGTGGAAGTCCCACAGAAGCTACAGCTGCCAGGTCACGCATGAAGGGAGCACCGTG
GAGAAGACAGTGGCCCCTACAGAATGTTCA

Engineering of hK2 scFvs-Fc for hK2/CD3 Bispecific Generation hK2 VH/VL regions engineered as scFvs in either VH-Linker-VL or VL-linker-VH orientations using the linker of SEQ ID NO: 31 (Table 2), as described in Example 2, were further engineered into a scFv-hinge-CH2-CH3 format comprising the Fc silencing mutation (L234A/L235A/D265S) and the T350V/T366L/K392L/T394W mutations designed to promote selective heterodimerization and expressed as IgG1 (Table 33). The polypeptide of SEQ ID NO: 321 was used as the constant domain hinge-CH2-CH3 (Fc).

(huIgG1_G1m(17)-hinge-Fc_C220S_AAS_ZWB)

SEQ ID NO: 321

EPKSSDKTHTCPPCPAPEAAGGPSVFLFPPKPKDTLMISRTPEVTCVVV

SVSHEDPEVKFNWYVDGVEVHNAKTKPREEQYNSTYRVVSVLTVLHQDW

LNGKEYKCKVSNKALPAPIEKTISKAKGQPREPQVYVLPPSREEMTKNQ

VSLLCLVKGFYPSDIAVEWESNGQPENNYLTWPPVLDSDGSFFLYSKLT

VDKSRWQQGNVFSCSVMHEALHNHYTQKSLSLSPG

TABLE 33

Amino acid sequences of anti-hK2 scFvs-Fc for hK2/CD3 bispecific generation

| Protein | SEQ ID NO: | Amino acid sequence |
|---|---|---|
| KL2B359-LH-scFv-Fc | 322 | EIVLTQSPATLSLSPGERATLSCRASESVEYFGTSLMHWY QQKPGQPPRLLIYAASNVESGIPARFSGSGSGTDFTLTISSV EPEDFAVYFCQQTRKVPYTFGGGTKVEIKGGSEGKSSGSG SESKSTGGSQVQLQESGPGLVKPSQTLSLTCTVSGNSITSD YAWNWIRQFPGKRLEWIGYISYSGSTTYNPSLKSRVTISR DTSKNQFSLKLSSVTAADTAVYYCATGYYYGSGFWGQG TLVTVSSEPKSSDKTHTCPPCPAPEAAGGPSVFLFPPKPKD TLMISRTPEVTCVVVSVSHEDPEVKFNWYVDGVEVHNAK TKPREEQYNSTYRVVSVLTVLHQDWLNGKEYKCKVSNK ALPAPIEKTISKAKGQPREPQVYVLPPSREEMTKNQVSLLC LVKGFYPSDIAVEWESNGQPENNYLTWPPVLDSDGSFFLY SKLTVDKSRWQQGNVFSCSVMHEALHNHYTQKSLSLSPG |

TABLE 33-continued

Amino acid sequences of anti-hK2 scFvs-Fc for hK2/CD3 bispecific generation

| Protein | SEQ ID NO: | Amino acid sequence |
|---|---|---|
| KL2B413-LH-scFv-Fc | 323 | EIVLTQSPSFLSASVGDRVTITCRASQGISSYLSWYQQKPG KAPKLLIYATSTLQSGVPSRFSGSGSGTEFTLTISSLQPEDF ATYYCQQLNSYPRTFGQGTKVEIKGGSEGKSSGSGSESKS TGGSEVQLVESGGGLVQPGGSLRLSCAASGFTFSSYWMT WVRQAPGKGLEWVANIKQDGSERYYVDSVKGRFTISRD NAKNSLYLQMNSLRAEDTAVYYCARDQNYDILTGHYGM DVWGQGTTVTVSSEPKSSDKTHTCPPCPAPEAAGGPSVFL FPPKPKDTLMISRTPEVTCVVVSVSHEDPEVKFNWYVDG VEVHNAKTKPREEQYNSTYRVVSVLTVLHQDWLNGKEY KCKVSNKALPAPIEKTISKAKGQPREPQVYVLPPSREEMT KNQVSLLCLVKGFYPSDIAVEWESNGQPENNYLTWPPVL DSDGSFFLYSKLTVDKSRWQQGNVFSCSVMHEALHNHY TQKSLSLSPG |
| KL2B467-LH-scFv-Fc | 324 | QSVLTQPPSVSVAPGQTASITCGGDNIGSKSVHWYQQKPG QAPVLVVYDNSDRPSGIPERFSGSNSGTTATLTISRVEAGD EADYYCQVWDSSSDHPVVFGGGTKVTVLGGSEGKSSGS GSESKSTGGSQVQLVESGGGVVQPGRSLRLSCAASGFTFS YYGMHWVRQAPGKGLEWVAFISYDGSNKYYADSVKGR FTISRDNSKNTLYLQMNSLRAEDTAVYYCAHLPYSGSYW AFDYWGQGTQVTVSSEPKSSDKTHTCPPCPAPEAAGGPS VFLFPPKPKDTLMISRTPEVTCVVVSVSHEDPEVKFNWYV DGVEVHNAKTKPREEQYNSTYRVVSVLTVLHQDWLNGK EYKCKVSNKALPAPIEKTISKAKGQPREPQVYVLPPSREE MTKNQVSLLCLVKGFYPSDIAVEWESNGQPENNYLTWPP VLDSDGSFFLYSKLTVDKSRWQQGNVFSCSVMHEALHN HYTQKSLSLSPG |
| KL2B494-LH-scFv-Fc | 325 | SSELTQPPSVSVAPGQTARITCGGNNIGSKSVHWYQQKPG QAPVLVVYDDSDRPSGIPERFSGSNSGNTATLTISRVEAGD EADYYCQVWDSSSDHVVFGGGTKLTVLGGSEGKSSGSGS ESKSTGGSQVQLVESGGGLVQPGGSLRLSCAASGFTFSHY AMSWVRQAPGKGLEWVSTIGGSGGSTYYADSVKGRFTIS RDNSKNTLYLQMNSLRAEDTAVYYCAKPHIVMVTALLY DGMDVWGQGTMVTVSSEPKSSDKTHTCPPCPAPEAAGG PSVFLFPPKPKDTLMISRTPEVTCVVVSVSHEDPEVKFNW YVDGVEVHNAKTKPREEQYNSTYRVVSVLTVLHQDWLN GKEYKCKVSNKALPAPIEKTISKAKGQPREPQVYVLPPSR EEMTKNQVSLLCLVKGFYPSDIAVEWESNGQPENNYLTW PPVLDSDGSFFLYSKLTVDKSRWQQGNVFSCSVMHEALH NHYTQKSLSLSPG |

Engineering of hK2 Fab-Fc for hK2/CD3 Bispecific Generation

The hK2 specific VH and VL regions were engineered in VH-CH1-linker-CH2-CH3 and VL-CL formats respectively. The polypeptide of SEQ ID NO: 326 comprising the Fc silencing mutation L234A/L235A/D265S and the CH3 mutation T350V/T366L/K392L/T394W designed to promote selective heterodimerization was used to generate the CD3 specific VH-CH1-linker-CH2-CH3).

(huIgG1_G1m(17)_AAS_ZWB)

SEQ ID NO: 326

ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKKV

EPKSCDKTHTCPPCPAPEAAGGPSVFLFPPKPKDTLMISRTPEVTCVVV

SVSHEDPEVKFNWYVDGVEVHNAKTKPREEQYNSTYRVVSVLTVLHQDW

LNGKEYKCKVSNKALPAPIEKTISKAKGQPREPQVYVLPPSREEMTKNQ

VSLLCLVKGFYPSDIAVEWESNGQPENNYLTWPPVLDSDGSFFLYSKLT

VDKSRWQQGNVFSCSVMHEALHNHYTQKSLSLSPGK

The polypeptides of SEQ ID NO: 363 or 364 were used to generate the hK2 specific VL-CL.

(human kappa light chain)

SEQ ID NO: 363

RTVAAPSVFIFPPSDEQLKSGTASVVCLLNNFYPREAKVQWKVDNALQS

GNSQESVTEQDSKDSTYSLSSTLTLSKADYEKHKVYACEVTHQGLSSPV

TKSFNRGEC (human lambda light chain)

SEQ ID NO: 364

GQPKAAPSVTLFPPSSEELQANKATLVCLISDFYPGAVTVAWKADSSPV

KAGVETTTPSKQSNNKYAASSYLSLTPEQWKSHRSYSCQVTHEGSTVEK

TVAPTECS

The amino acid sequences of hK2 Fab-Fc HCare shown in Table 34.

TABLE 34

Amino acid sequences for anti-hK2 Fab-Fc for hK2/CD3 bispecific generation

| Protein | SEQ ID NO: | Amino acid sequence |
|---|---|---|
| KL2B30 Fab HC | 327 | QVQLQESGPGLVKPSETLSLTCTVSGGSISSYYWSWIRQPP GKGLEWIGYIYYSGSTNYNPSLKSRVTISVDTSKNQFSLKL SSVTAADTAVYYCAGTTIFGVVTPNFYYGMDVWGQGTT VTVSSASTKGPSVFPLAPSSKSTSGGTAALGCLVKDYFPEP VTVSWNSGALTSGVHTFPAVLQSSGLYSLSSVVTVPSSSL GTQTYICNVNHKPSNTKVDKKVEPKSCDKTHTCPPCPAPE AAGGPSVFLFPPKPKDTLMISRTPEVTCVVVSVSHEDPEV KFNWYVDGVEVHNAKTKPREEQYNSTYRVVSVLTVLHQ DWLNGKEYKCKVSNKALPAPIEKTISKAKGQPREPQVYV LPPSREEMTKNQVSLLCLVKGFYPSDIAVEWESNGQPENN YLTWPPVLDSDGSFFLYSKLTVDKSRWQQGNVFSCSVMH EALHNHYTQKSLSLSPG |
| KL2B242 Fab HC | 328 | QVQLQESGPGLVKPSETLSLTCTVSGGSISSYYWSWLRQP AGSGLEWIGRLYVSGFTNYNPSLKSRVTLSLDPSRNQLSL KLSSVTAADTAVYYCAGDSGNYWGWFDPWGQGTLVTV SSASTKGPSVFPLAPSSKSTSGGTAALGCLVKDYFPEPVTV SWNSGALTSGVHTFPAVLQSSGLYSLSSVVTVPSSSLGTQ TYICNVNHKPSNTKVDKKVEPKSCDKTHTCPPCPAPEAA GGPSVFLFPPKPKDTLMISRTPEVTCVVVSVSHEDPEVKFN WYVDGVEVHNAKTKPREEQYNSTYRVVSVLTVLHQDW LNGKEYKCKVSNKALPAPIEKTISKAKGQPREPQVYVLPP SREEMTKNQVSLLCLVKGFYPSDIAVEWESNGQPENNYL TWPPVLDSDGSFFLYSKLTVDKSRWQQGNVFSCSVMHEA LHNHYTQKSLSLSPG |
| KL2B53 Fab HC | 329 | EVQLVESGGGVVQPGRSLRLSCVASGFTFSSYDIHWVRQ APGKGLEWVAIISYDGSKKDYTDSVKGRFTISRDNSKNTL YLQMDSLRVEDSAVYSCARESGWSHYYYYGMDVWGQG TMVTVSSASTKGPSVFPLAPSSKSTSGGTAALGCLVKDYF PEPVTVSWNSGALTSGVHTFPAVLQSSGLYSLSSVVTVPS SSLGTQTYICNVNHKPSNTKVDKKVEPKSCDKTHTCPPCP APEAAGGPSVFLFPPKPKDTLMISRTPEVTCVVVSVSHEDP EVKFNWYVDGVEVHNAKTKPREEQYNSTYRVVSVLTVL HQDWLNGKEYKCKVSNKALPAPIEKTISKAKGQPREPQV YVLPPSREEMTKNQVSLLCLVKGFYPSDIAVEWESNGQPE NNYLTWPPVLDSDGSFFLYSKLTVDKSRWQQGNVFSCSV MHEALHNHYTQKSLSLSPG |
| KL2B30 Fab w/K477 | 330 | QVQLQESGPGLVKPSETLSLTCTVSGGSISSYYWSWIRQPP GKGLEWIGYIYYSGSTNYNPSLKSRVTISVDTSKNQFSLKL SSVTAADTAVYYCAGTTIFGVVTPNFYYGMDVWGQGTT VTVSSASTKGPSVFPLAPSSKSTSGGTAALGCLVKDYFPEP VTVSWNSGALTSGVHTFPAVLQSSGLYSLSSVVTVPSSSL GTQTYICNVNHKPSNTKVDKKVEPKSCDKTHTCPPCPAPE AAGGPSVFLFPPKPKDTLMISRTPEVTCVVVSVSHEDPEV KFNWYVDGVEVHNAKTKPREEQYNSTYRVVSVLTVLHQ DWLNGKEYKCKVSNKALPAPIEKTISKAKGQPREPQVYV LPPSREEMTKNQVSLLCLVKGFYPSDIAVEWESNGQPENN YLTWPPVLDSDGSFFLYSKLTVDKSRWQQGNVFSCSVMH EALHNHYTQKSLSLSPGK |

hK2/CD3 Bispecifics

CD3W245 and CD3B376 anti-CD3 specific arms, engineered as Fabs, and the hK2 VH/VL regions of KL2B359, KL2B413, KL2B467 and KL2B494 engineered as scFvs in both HL and LH orientations as described above, were expressed to generate bispecific antibodies, yielding hK2/CD3 bispecific antibodies with a hK2 binding arm in a format scFv-hinge-CH2-CH3 and a CD3 binding arm in a format of: heavy chain: VH-CH1-linker-CH2-CH3 and light chain: VL-CL. Alternatively, the VH/VL regions of the anti-CD3 antibodies CD3W245 engineered as scFvs in the LH-linker-VH orientation and the VH/VL regions of the anti-hK2 antibodies KL2B30, KL2B242 and KL2B53 engineered as Fabs as described above, were expressed to generate bispecific antibodies, yielding hK2/CD3 bispecific antibodies with a hK2 binding arm in the format of a heavy chain VH-CH1-linker-CH2-CH3 and light chain VL-CL and a CD3 binding arm in a format scFv-hinge-CH2-CH3. The linker used to generate the anti-scFv is the linker of SEQ ID NO: 31.

T350V_L351Y_F405A_Y407V CH3 mutations were engineered into one heavy chain and T350V_T366L_K392L_T394W CH3 mutations were engineered into the other heavy chain as described above. In addition, both HK2 and CD3 binding arms were engineered to contain Fc effector silencing mutations L234A_L235A_D265S as described above.

The engineered chains were expressed, and the resulting bispecific antibodies purified using standard methods. The bispecific antibodies were characterized for their binding to hK2 and CD3, and their cytotoxicity as described in Example 5. Table 35 shows the CDR SEQ ID NOs: of selected anti hKL2/CD3 bispecific antibodies. Table 36 shows the VH, VL and scFv SEQ ID NOs: of selected anti hKL2/CD3 bispecific antibodies. Table 37 shows the HC1, HC2, LC1 and LC2 SEQ ID NOs of selected anti hKL2/CD3 bispecific antibodies. HC1 and LC1 refer to the heavy and light chain of the hKL2 binding arm. Alternatively, HC1 can also refer to the scFv-hinge-CH2-CH3 of the hK12 binding arm. HC2 and LC2 refer to the heavy and light chain of the CD3 binding arm. Alternatively, HC2 can also refer to the scFv-hinge-CH2-CH3 of the CD3 binding arm. Table 38 shows the amino acid sequences of HC1, LC1, HC2 and LC2. Table 39 shows the cDNA sequences of HC1, LC1, HC2 and LC2.

TABLE 35

Kabat CDR SEQ ID NOs of bispecific hK2/CD3 antibodies

| Bispecific antibody | Parental (hK2 arm/CD3 arm) | HCDR1 | HCDR2 | HCDR3 | LCDR1 | LCDR2 | LCDR3 |
|---|---|---|---|---|---|---|---|
| KLCB91 | KL2B359-LH-scFv | 149 | 152 | 151 | 171 | 172 | 173 |
| | CD3W245 Fab | 6 | 7 | 8 | 9 | 10 | 11 |
| KLCB105 | KL2B359-LH-scFv | 149 | 152 | 151 | 171 | 172 | 173 |
| | CD3B376 Fab | 340 | 341 | 342 | 343 | 344 | 345 |
| KLCB95 | KL2B413-LHscFv | 153 | 154 | 155 | 176 | 177 | 178 |
| | CD3W245 Fab | 6 | 7 | 8 | 9 | 10 | 11 |
| KLCB96 | KL2B413-LH-scFv | 153 | 154 | 155 | 176 | 177 | 178 |
| | CD3B376 Fab | 340 | 341 | 342 | 343 | 344 | 345 |
| KLCB170 | KL2B467-LH-scFv | 165 | 166 | 167 | 191 | 192 | 193 |
| | CD3W245 Fab | 6 | 7 | 8 | 9 | 10 | 11 |
| KLCB80 | KL2B30 Fab | 156 | 157 | 158 | 182 | 183 | 184 |
| | CD3W245-LH-scFv | 6 | 7 | 8 | 9 | 10 | 11 |
| KLCB81 | KL2B242 LC__C33S Fab | 162 | 163 | 164 | 185 | 186 | 187 |
| | CD3W245-LH-scFv | 6 | 7 | 8 | 9 | 10 | 11 |
| KLCB113 | KL2B53 Fab | 159 | 160 | 161 | 179 | 180 | 181 |
| | CD3W245-LH-scFv | 6 | 7 | 8 | 9 | 10 | 11 |
| KLCB281 | KL2B467-LH-scFv | 165 | 166 | 167 | 191 | 192 | 193 |
| | CD3B376-Fab | 340 | 341 | 342 | 343 | 344 | 345 |
| KLCB174 | KL2B494-LH-scFv | 168 | 169 | 170 | 191 | 192 | 188 |
| | CD3B376-Fab | 340 | 341 | 342 | 343 | 344 | 345 |
| KLCB153 | KL2B494-LH-scFv | 168 | 169 | 170 | 191 | 192 | 188 |
| | CD3W245-Fab | 6 | 7 | 8 | 9 | 10 | 11 |
| KLCB245 | KL2B30-Fab w/ K447 | 156 | 157 | 158 | 182 | 183 | 184 |
| | CD3W245-LH-scFv w/K447 | 6 | 7 | 8 | 9 | 10 | 11 |

TABLE 36

SEQ ID NOs of the variable region of the hKL2 arm and the CD3 arm of selected KL2/CD3 bispecific antibodies.

| | hK2 arm | | | | CD3 arm | | | |
|---|---|---|---|---|---|---|---|---|
| Bispecific Name | Name | VH1 SEQ ID NO: | VL1 SEQ ID NO: | scFv SEQ ID NO | Name | VH2 SEQ ID NO: | VL2 SEQ ID NO: | scFv SEQ ID NO: |
| KLCB91 | KL2B359-LH-scFv(scFv20) | | | 281 | CD3W245 Fab | 23 | 28 | |
| KLCB105 | KL2B359-LHscFv (scFv20) | | | 281 | CD3B376 Fab | 346 | 347 | |
| KLCB95 | KL2B413-LH-scFv (scFvl8) | | | 279 | CD3W245 Fab | 23 | 28 | |
| KLCB96 | KL2B413-LH-scFv(scFvl8) | | | 279 | CD3B376 Fab | 346 | 347 | |
| KLCB170 | KL2B467-LH-scFv(scFv28) | | | 289 | CD3W245 Fab | 23 | 28 | |
| KLCB80 | KL2B30 Fab | 139 | 140 | | CD3W245-LH-scFv (scFv34) | | | 348 |
| KLCB81 | KL2B242 LC__C33S Fab | 143 | 358 | | CD3W245-LH-scFv (scFv34) | | | 348 |
| KLCB113 | KL2B53 Fab | 141 | 142 | | CD3W245-LH-scFv (scFv34) | | | 348 |
| KLCB281 | KL2B467-LH-scFv (scFv28) | | | 289 | CD3B376 Fab | 346 | 347 | |
| KLCB174 | KL2B494-LH-scFv | | | 291 | CD3B376-Fab | 346 | 347 | |

TABLE 36-continued

SEQ ID NOs of the variable region of the hKL2 arm and the CD3 arm of selected KL2/CD3 bispecific antibodies.

| | hK2 arm | | | | CD3 arm | | | |
|---|---|---|---|---|---|---|---|---|
| Bispecific Name | Name | VH1 SEQ ID NO: | VL1 SEQ ID NO: | scFv SEQ ID NO | Name | VH2 SEQ ID NO: | VL2 SEQ ID NO: | scFv SEQ ID NO: |
| KLCB153 | KL2B494-LH-scFv | | | 352 | CD3W245-Fab | 23 | 28 | |
| KLCB245 | KL2B30-Fab w/K447 | 139 | 140 | | CD3W245-LH-scFv w/K447 | | | 348 |

TABLE 37

HC and LC amino acid SEQ ID NOs of hK2/CD3 bispecific antibodies

| | hK2 arm | | | CD3 arm | | |
|---|---|---|---|---|---|---|
| Bispecific Name | Name | HC1 or scFv - Fc SEQ ID NO: | LC1 SEQ ID NO: | Name | HC2 or scFv - Fc SEQ ID NO: | LC2 SEQ ID NO: |
| KLCB91 | KL2B359 LH-Fc | 322 | | CD3W245 Fab | 85 | 88 |
| KLCB105 | KL2B359-LH-Fc | 322 | | CD3B376 Fab | 349 | 350 |
| KLCB95 | KL2B413-LH-Fc | 323 | | CD3W245 Fab | 85 | 88 |
| KLCB96 | KL2B413-LH-Fc | 323 | | CD3B376 Fab | 349 | 350 |
| KLCB170 | KL2B467-LH-Fc | 324 | | CD3W245 Fab | 85 | 88 |
| KLCB80 | KL2B30 Fab | 327 | 221 | CD3W245-LH-scFv-Fc | 78 | |
| KLCB81 | KL2B242 LC__C33S Fab | 328 | 359 | CD3W245-LH-scFv-Fc | 78 | |
| KLCB113 | KL2B53 Fab | 329 | 222 | CD3W245-LH-scFv-Fc | 78 | |
| KLCB281 | KL2B467-LH-scFv (scFv28) | 324 | | CD3B376 Fab | 349 | 350 |
| KLCB174 | KL2B494-LH-scFv | 325 | | CD3B376-Fab | 349 | 350 |
| KLCB153 | KL2B494-LH-scFv | 325 | | CD3W245-Fab | 85 | 88 |
| KLCB245 | KL2B30-Fab w/K447 | 330 | 221 | CD3W245-LH-scFv w/K447 | 331 | |

TABLE 38

Bispecific HC1 and HC2 amino acid sequences

| Protein | SEQ ID NO: | Amino acid sequence |
|---|---|---|
| KL2B359-LH-scFv-Fc | 322 | EIVLTQSPATLSLSPGERATLSCRASESVEYFGTSLMHW YQQKPGQPPRLLIYAASNVESGIPARFSGSGSGTDFTLTIS SVEPEDFAVYFCQQTRKVPYTFGGGTKVEIKGGSEGKSS GSGSESKSTGGSQVQLQESGPGLVKPSQTLSLTCTVSGN SITSDYAWNWIRQFPGKRLEWIGYISYSGSTTYNPSLKSR VTISRDTSKNQFSLKLSSVTAADTAVYYCATGYYYGSGF WGQGTLVTVSSEPKSSDKTHTCPPCPAPEAAGGPSVFLF PPKPKDTLMISRTPEVTCVVVSVSHEDPEVKFNWYVDG VEVHNAKTKPREEQYNSTYRVVSVLTVLHQDWLNGKE YKCKVSNKALPAPIEKTISKAKGQPREPQVYVLPPSREE MTKNQVSLLCLVKGFYPSDIAVEWESNGQPENNYLTWP PVLDSDGSFFLYSKLTVDKSRWQQGNVFSCSVMHEALH NHYTQKSLSLSPG |
| KL2B413-LH-scFv-Fc | 323 | EIVLTQSPSFLSASVGDRVTITCRASQGISSYLSWYQQKP GKAPKLLIYATSTLQSGVPSRFSGSGSGTEFTLTISSLQPE DFATYYCQQLNSYPRTFGQGTKVEIKGGSEGKSSGSGSE SKSTGGSEVQLVESGGGLVQPGGSLRLSCAASGFTFSSY WMTWVRQAPGKGLEWVANIKQDGSERYYVDSVKGRF TISRDNAKNSLYLQMNSLRAEDTAVYYCARDQNYDILT GHYGMDVWGQGTTVTVSSEPKSSDKTHTCPPCPAPEAA GGPSVFLFPPKPKDTLMISRTPEVTCVVVSVSHEDPEVKF NWYVDGVEVHNAKTKPREEQYNSTYRVVSVLTVLHQD |

TABLE 38-continued

Bispecific HC1 and HC2 amino acid sequences

| Protein | SEQ ID NO: | Amino acid sequence |
|---|---|---|
| | | WLNGKEYKCKVSNKALPAPIEKTISKAKGQPREPQVYV LPPSREEMTKNQVSLLCLVKGFYPSDIAVEWESNGQPEN NYLTWPPVLDSDGSFFLYSKLTVDKSRWQQGNVFSCSV MHEALHNHYTQKSLSLSPG |
| KL2B467-LH-scFv-Fc | 324 | QSVLTQPPSVSVAPGQTASITCGGDNIGSKSVHWYQQKP GQAPVLVVYDNSDRPSGIPERFSGSNSGTTATLTISRVEA GDEADYYCQVWDSSSDHPVVFGGGTKVTVLGGSEGKS SGSGSESKSTGGSQVQLVESGGGVVQPGRSLRLSCAASG FTFSYYGMHWVRQAPGKGLEWVAFISYDGSNKYYADS VKGRFTISRDNSKNTLYLQMNSLRAEDTAVYYCAHLPY SGSYWAFDYWGQGTQVTVSSEPKSSDKTHTCPPCPAPE AAGGPSVFLFPPKPKDTLMISRTPEVTCVVVSVSHEDPE VKFNWYVDGVEVHNAKTKPREEQYNSTYRVVSVLTVL HQDWLNGKEYKCKVSNKALPAPIEKTISKAKGQPREPQ VYVLPPSREEMTKNQVSLLCLVKGFYPSDIAVEWESNG QPENNYLTWPPVLDSDGSFFLYSKLTVDKSRWQQGNVF SCSVMHEALHNHYTQKSLSLSPG |
| KL2B30 Fab HC | 327 | QVQLQESGPGLVKPSETLSLTCTVSGGSISSYYWSWIRQ PPGKGLEWIGYIYYSGSTNYNPSLKSRVTISVDTSKNQFS LKLSSVTAADTAVYYCAGTTIFGVVTPNFYYGMDVWG QGTTVTVSSASTKGPSVFPLAPSSKSTSGGTAALGCLVK DYFPEPVTVSWNSGALTSGVHTFPAVLQSSGLYSLSSVV TVPSSSLGTQTYICNVNHKPSNTKVDKKVEPKSCDKTHT CPPCPAPEAAGGPSVFLFPPKPKDTLMISRTPEVTCVVVS VSHEDPEVKFNWYVDGVEVHNAKTKPREEQYNSTYRV VSVLTVLHQDWLNGKEYKCKVSNKALPAPIEKTISKAK GQPREPQVYVLPPSREEMTKNQVSLLCLVKGFYPSDIAV EWESNGQPENNYLTWPPVLDSDGSFFLYSKLTVDKSRW QQGNVFSCSVMHEALHNHYTQKSLSLSPG |
| KL2B242 Fab HC | 328 | QVQLQESGPGLVKPSETLSLTCTVSGGSISSYYWSWLRQ PAGSGLEWIGRLYVSGFTNYNPSLKSRVTLSLDPSRNQL SLKLSSVTAADTAVYYCAGDSGNYWGWFDPWGQGTL VTVSSASTKGPSVFPLAPSSKSTSGGTAALGCLVKDYFP EPVTVSWNSGALTSGVHTFPAVLQSSGLYSLSSVVTVPS SSLGTQTYICNVNHKPSNTKVDKKVEPKSCDKTHTCPPC PAPEAAGGPSVFLFPPKPKDTLMISRTPEVTCVVVSVSHE DPEVKFNWYVDGVEVHNAKTKPREEQYNSTYRVVSVL TVLHQDWLNGKEYKCKVSNKALPAPIEKTISKAKGQPR EPQVYVLPPSREEMTKNQVSLLCLVKGFYPSDIAVEWES NGQPENNYLTWPPVLDSDGSFFLYSKLTVDKSRWQQGN VFSCSVMHEALHNHYTQKSLSLSPG |
| KL2B242LC_C33S_Fab LC | 359 | SYELTQPPSVSVSPGETASITCSGDQLGENYASWYQQKP GQSPVLVIYQDSKRPSGIPERFSGSNSGNTATLTISGTQA LDEADYYCQAWDNSIVVFGGGTKLTVLGQPKAAPSVTL FPPSSEELQANKATLVCLISDFYPGAVTVAWKADSSPVK AGVETTTPSKQSNNKYAASSYLSLTPEQWKSHRSYSCQ VTHEGSTVEKTVAPTECS |
| KL2B53 Fab HC | 329 | EVQLVESGGGVVQPGRSLRLSCVASGFTFSSYDIHWVR QAPGKGLEWVAIISYDGSKKDYTDSVKGRFTISRDNSKN TLYLQMDSLRVEDSAVYSCARESGWSHYYYYGMDVW GQGTMVTVSSASTKGPSVFPLAPSSKSTSGGTAALGCLV KDYFPEPVTVSWNSGALTSGVHTFPAVLQSSGLYSLSSV VTVPSSSLGTQTYICNVNHKPSNTKVDKKVEPKSCDKTH TCPPCPAPEAAGGPSVFLFPPKPKDTLMISRTPEVTCVVV SVSHEDPEVKFNWYVDGVEVHNAKTKPREEQYNSTYR VVSVLTVLHQDWLNGKEYKCKVSNKALPAPIEKTISKA KGQPREPQVYVLPPSREEMTKNQVSLLCLVKGFYPSDIA VEWESNGQPENNYLTWPPVLDSDGSFFLYSKLTVDKSR WQQGNVFSCSVMHEALHNHYTQKSLSLSPG |
| KL2B494-LH-scfV-Fc | 325 | SSELTQPPSVSVAPGQTARITCGGNNIGSKSVHWYQQKP GQAPVLVVYDDSDRPSGIPERFSGSNSGNTATLTISRVEA GDEADYYCQVWDSSSDHVVFGGGTKLTVLGGSEGKSS GSGSESKSTGGSQVQLVESGGGLVQPGGSLRLSCAASGF TFSHYAMSWVRQAPGKGLEWVSTIGGSGGSTYYADSV KGRFTISRDNSKNTLYLQMNSLRAEDTAVYYCAKPHIV MVTALLYDGMDVWGQGTMVTVSSEPKSSDKTHTCPPC PAPEAAGGPSVFLFPPKPKDTLMISRTPEVTCVVVSVSHE DPEVKFNWYVDGVEVHNAKTKPREEQYNSTYRVVSVL TVLHQDWLNGKEYKCKVSNKALPAPIEKTISKAKGQPR EPQVYVLPPSREEMTKNQVSLLCLVKGFYPSDIAVEWES |

TABLE 38-continued

| Bispecific HC1 and HC2 amino acid sequences | | |
|---|---|---|
| Protein | SEQ ID NO: | Amino acid sequence |
| | | NGQPENNYLTWPPVLDSDGSFFLYSKLTVDKSRWQQGN VFSCSVMHEALHNHYTQKSLSLSPG |
| KL2B30 Fab w/K477 | 330 | QVQLQESGPGLVKPSETLSLTCTVSGGSISSYYWSWIRQ PPGKGLEWIGYIYYSGSTNYNPSLKSRVTISVDTSKNQFS LKLSSVTAADTAVYYCAGTTIFGVVTPNFYYGMDVWG QGTTVTVSSASTKGPSVFPLAPSSKSTSGGTAALGCLVK DYFPEPVTVSWNSGALTSGVHTFPAVLQSSGLYSLSSVV TVPSSSLGTQTYICNVNHKPSNTKVDKKVEPKSCDKTHT CPPCPAPEAAGGPSVFLFPPKPKDTLMISRTPEVTCVVVS VSHEDPEVKFNWYVDGVEVHNAKTKPREEQYNSTYRV VSVLTVLHQDWLNGKEYKCKVSNKALPAPIEKTISKAK GQPREPQVYVLPPSREEMTKNQVSLLCLVKGFYPSDIAV EWESNGQPENNYLTWPPVLDSDGSFFLYSKLTVDKSRW QQGNVFSCSVMHEALHNHYTQKSLSLSPGK |
| CD3W245 Fab HC | 85 | EVQLVESGGGLVKPGGSLRLSCAASGFTFSRYNMNWVR QAPGKGLEWVSSISTSSNYIYYADSVKGRFTFSRDNAKN SLDLQMSGLRAEDTAIYYCTRGWGPFDYWGQGTLVTV SSASTKGPSVFPLAPSSKSTSGGTAALGCLVKDYFPEPVT VSWNSGALTSGVHTFPAVLQSSGLYSLSSVVTVPSSSLG TQTYICNVNHKPSNTKVDKKVEPKSCDKTHTCPPCPAPE AAGGPSVFLFPPKPKDTLMISRTPEVTCVVVSVSHEDPE VKFNWYVDGVEVHNAKTKPREEQYNSTYRVVSVLTVL HQDWLNGKEYKCKVSNKALPAPIEKTISKAKGQPREPQ VYVYPPSREEMTKNQVSLTCLVKGFYPSDIAVEWESNG QPENNYKTTPPVLDSDGSFALVSKLTVDKSRWQQGNVF SCSVMHEALHNHYTQKSLSLSPG |
| CD3B376 Fab | 349 | QVQLQQSGPRLVRPSQTLSLTCAISGDSVFNNNAAWSWI RQSPSRGLEWLGRTYYRSKWLYDYAVSVKSRITVNPDT SRNQFTLQLNSVTPEDTALYYCARGYSSSFDYWGQGTL VTVSSASTKGPSVFPLAPSSKSTSGGTAALGCLVKDYFP EPVTVSWNSGALTSGVHTFPAVLQSSGLYSLSSVVTVPS SSLGTQTYICNVNHKPSNTKVDKKVEPKSCDKTHTCPPC PAPEAAGGPSVFLFPPKPKDTLMISRTPEVTCVVVSVSHE DPEVKFNWYVDGVEVHNAKTKPREEQYNSTYRVVSVL TVLHQDWLNGKEYKCKVSNKALPAPIEKTISKAKGQPR EPQVYVYPPSREEMTKNQVSLTCLVKGFYPSDIAVEWES NGQPENNYKTTPPVLDSDGSFALVSKLTVDKSRWQQGN VFSCSVMHEALHNHYTQKSLSLSPG |
| CD3W245-LH-scfv-Fc | 78 | DIQMTQSPSSLSASVGDRVTITCRARQSIGTAIHWYQQK PGKAPKLLIKYASESISGVPSRFSGSGSGTDFTLTISSLQP EDFATYYCQQSGSWPYTFGQGTKLEIKGGSEGKSSGSGS ESKSTGGSEVQLVESGGGLVKPGGSLRLSCAASGFTFSR YNMNWVRQAPGKGLEWVSSISTSSNYIYYADSVKGRFT FSRDNAKNSLDLQMSGLRAEDTAIYYCTRGWGPFDYW GQGTLVTVSSEPKSSDKTHTCPPCPAPEAAGGPSVFLFPP KPKDTLMISRTPEVTCVVVSVSHEDPEVKFNWYVDGVE VHNAKTKPREEQYNSTYRVVSVLTVLHQDWLNGKEYK CKVSNKALPAPIEKTISKAKGQPREPQVYVYPPSREEMT KNQVSLTCLVKGFYPSDIAVEWESNGQPENNYKTTPPV LDSDGSFALVSKLTVDKSRWQQGNVFSCSVMHEALHN HYTQKSLSLSPG |
| CD3W245-LH-scfv-Fc w/K447 | 331 | DIQMTQSPSSLSASVGDRVTITCRARQSIGTAIHWYQQK PGKAPKLLIKYASESISGVPSRFSGSGSGTDFTLTISSLQP EDFATYYCQQSGSWPYTFGQGTKLEIKGGSEGKSSGSGS ESKSTGGSEVQLVESGGGLVKPGGSLRLSCAASGFTFSR YNMNWVRQAPGKGLEWVSSISTSSNYIYYADSVKGRFT FSRDNAKNSLDLQMSGLRAEDTAIYYCTRGWGPFDYW GQGTLVTVSSEPKSSDKTHTCPPCPAPEAAGGPSVFLFPP KPKDTLMISRTPEVTCVVVSVSHEDPEVKFNWYVDGVE VHNAKTKPREEQYNSTYRVVSVLTVLHQDWLNGKEYK CKVSNKALPAPIEKTISKAKGQPREPQVYVYPPSREEMT KNQVSLTCLVKGFYPSDIAVEWESNGQPENNYKTTPPV LDSDGSFALVSKLTVDKSRWQQGNVFSCSVMHEALHN HYTQKSLSLSPGK |

TABLE 39

HC and LC DNA SEQ ID NOs of hK2/CD3 bispecific antibodies

| | hK2 arm | | | CD3 arm | | |
|---|---|---|---|---|---|---|
| Bispecific Name | Name | HC1 or scFv-Fc DNA SEQ ID NO: | LC1 DNA SEQ ID NO: | Name | HC2 or scFv-Fc DNA SEQ ID NO: | LC2 DNA SEQ ID NO: |
| KLCB91 | KL2B359 LH-scFv-Fc | 332 | | CD3W245 Fab | 315 | 88 |
| KLCB105 | KL2B359-LH-scFv-Fc | 332 | | CD3B376 Fab | 351 | 352 |
| KLCB95 | KL2B413-LH-scFv-Fc | 333 | | CD3W245 Fab | 315 | 317 |
| KLCB96 | KL2B413-LH-scFv-Fc | 333 | | CD3B376 Fab | 351 | 352 |
| KLCB170 | KL2B467-LH-scFv-Fc | 334 | | CD3W245 Fab | 315 | 317 |
| KLCB80 | KL2B30 Fab | 335 | 257 | CD3W245-LH-scFv-Fc | 353 | |
| KLCB81 | KL2B242 LC_C33S Fab | 336 | 360 | CD3W245-LH-scFv-Fc | 353 | |
| KLCB113 | KL2B53 Fab | 337 | 258 | CD3W245-LH-scFv-Fc | 353 | |
| KLCB281 | KL2B467-LH-scFv-Fc | 334 | | CD3B376 Fab | 351 | 352 |
| KLCB174 | KL2B494-LH-scFv | 338 | | CD3B376-Fab | 351 | 352 |
| KLCB153 | KL2B494-LH-scFv | 338 | | CD3W245-Fab | 315 | 317 |
| KLCB245 | KL2B30-Fab w/ K447 | 339 | 257 | CD3W245-LH-scFv-Fc w/ K447 | 354 | |

(KL2B359-LH-scFv-Fc)

SEQ ID NO: 332

GAGATTGTTCTCACCCAATCCCCAGCTACTCTCTCTCTTTCACCCGGTGAGCGGGCAACCCTC
TCCTGTAGAGCCAGCGAGAGCGTGGAGTATTTTGGCACATCCCTGATGCACTGGTATCAGCA
AAAACCAGGACAACCCCCCAGACTCCTCATATATGCCGCCTCAAATGTCGAGAGTGGGATA
CCTGCACGGTTTTCAGGAAGCGGCAGCGGTACTGACTTCACATTGACTATATCCTCTGTAGA
GCCAGAGGATTTTGCAGTCTACTTCTGCCAGCAAACTAGGAAGGTTCCATATACTTTTGGGG
GCGGTACAAAAGTTGAGATAAAGGGCGGCTCCGAGGGCAAGAGCAGCGGCAGCGGCAGCG
AGAGCAAGAGCACCGGCGGCAGCCAAGTACAGCTCCAGGAGTCAGGACCTGGGCTCGTCAA
ACCATCTCAGACATTGTCCCTGACATGCACAGTTTCCGGCAACAGTATTACTTCCGACTATGC
TTGGAATTGGATCAGGCAATTCCCAGGAAAGCGGCTCGAGTGGATAGGTTATATTTCTTACT
CTGGATCTACTACCTACAATCCCAGTTTGAAGTCTCGCGTGACAATTAGCCGGGACACATCA
AAAAATCAATTCTCACTTAAACTTAGTTCTGTAACCGCTGCCGATACAGCCGTGTACTACTG
CGCCACTGGTTATTATTATGGAAGCGGATTTTGGGGGCAAGGAACTTTGGTGACCGTCTCTT
CCGAGCCCAAATCTAGCGACAAAACTCACACATGTCCACCGTGCCCAGCACCTGAAGCAGC
AGGGGGACCGTCAGTCTTCCTCTTCCCCCCAAAACCCAAGGACACCCTCATGATCTCCCGGA
CCCCTGAGGTCACATGCGTGGTGGTGAGCGTGAGCCACGAAGACCCTGAGGTCAAGTTCAA
CTGGTACGTGGACGGCGTGGAGGTGCATAATGCCAAGACAAAGCCGCGGGAGGAGCAGTAC
AACAGCACGTACCGTGTGGTCAGCGTCCTCACCGTCCTGCACCAGGACTGGCTGAATGGCAA
GGAGTACAAGTGCAAGGTCTCCAACAAAGCCCTCCCAGCCCCCATCGAGAAAACCATCTCC
AAAGCCAAAGGGCAGCCCCGAGAACCACAGGTGTACGTGCTGCCCCCATCCCGGGAGGAGA
TGACCAAGAACCAGGTCAGCCTGCTGTGCCTGGTCAAAGGCTTCTATCCCAGCGACATCGCC
GTGGAGTGGGAGAGCAATGGGCAGCCGGAGAACAACTACCTCACCTGGCCTCCCGTGCTGG
ACTCCGACGGCTCCTTCTTCCTCTACAGCAAGCTCACCGTGGACAAGTCTAGATGGCAGCAG
GGGAACGTCTTCTCATGCTCCGTGATGCATGAGGCTCTGCACAACCACTACACGCAGAAGAG
CCTCTCCCTGTCTCCGGGT (KL2B413-LH-scFv-Fc)

SEQ ID NO: 333

GAGGTACAACTTGTCGAAAGTGGCGGTGGAGTCGTCCAGCCTGGGCGATCACTTCGCCTCTC
CTGTGTAGCCTCTGGTTTCACTTTCTCATCTTACGACATACACTGGGTCCGCCAGGCACCTGG
TAAGGGGCTGGAGTGGGTTGCCATCATTAGTTACGATGGCTCCAAAAAAGATTACACCGATA
GCGTAAAGGGCAGATTTACCATTTCCAGGGATAATTCAAAGAACACCCTGTATCTGCAAATG
GACAGCCTCCGCGTCGAAGACTCTGCAGTTTATAGCTGTGCCAGGGAGTCAGGCTGGTCCCA
TTATTACTATTATGGTATGGACGTTTGGGGCCAGGGAACCATGGTCACTGTTAGTTCAGCCTC
CACCAAGGGCCCATCGGTCTTCCCCCTGGCACCCTCCTCCAAGAGCACCTCTGGGGGCACAG
CGGCCCTGGGCTGCCTGGTCAAGGACTACTTCCCCGAACCGGTGACGGTGTCGTGGAACTCA

TABLE 39-continued

HC and LC DNA SEQ ID NOs of hK2/CD3 bispecific antibodies

GGCGCCCTGACCAGCGGCGTGCACACCTTCCCGGCTGTCCTACAGTCCTCAGGACTCTACTC
CCTCAGCAGCGTGGTGACCGTGCCCTCCAGCAGCTTGGGCACCCAGACCTACATCTGCAACG
TGAATCACAAGCCCAGCAACACCAAGGTGGACAAGAAAGTTGAGCCCAAATCTTGTGACAA
AACTCACACATGTCCACCGTGCCCAGCACCTGAAGCAGCAGGGGGACCGTCAGTCTTCCTCT
TCCCCCCAAAACCCAAGGACACCCTCATGATCTCCCGGACCCCTGAGGTCACATGCGTGGTG
GTGAGCGTGAGCCACGAAGACCCTGAGGTCAAGTTCAACTGGTACGTGGACGGCGTGGAGG
TGCATAATGCCAAGACAAAGCCGCGGGAGGAGCAGTACAACAGCACGTACCGTGTGGTCAG
CGTCCTCACCGTCCTGCACCAGGACTGGCTGAATGGCAAGGAGTACAAGTGCAAGGTCTCCA
ACAAAGCCCTCCCAGCCCCCATCGAGAAAACCATCTCCAAAGCCAAAGGGCAGCCCCGAGA
ACCACAGGTGTACGTGCTGCCCCCATCCCGGGAGGAGATGACCAAGAACCAGGTCAGCCTG
CTGTGCCTGGTCAAAGGCTTCTATCCCAGCGACATCGCCGTGGAGTGGGAGAGCAATGGGC
AGCCGGAGAACAACTACCTCACCTGGCCTCCCGTGCTGGACTCCGACGGCTCCTTCTTCCTCT
ACAGCAAGCTCACCGTGGACAAGTCTAGATGGCAGCAGGGGAACGTCTTCTCATGCTCCGTG
ATGCATGAGGCTCTGCACAACCACTACACGCAGAAGAGCCTCTCCCTGTCTCCGGGT (KL2B467-LH-scFv-Fc)

SEQ ID NO: 334

CAGAGCGTACTTACCCAGCCTCCCAGCGTGTCTGTAGCCCCAGGACAGACAGCCAGTATTAC
ATGCGGTGGTGACAATATAGGTTCCAAATCCGTGCATTGGTACCAGCAGAAGCCAGGGCAA
GCTCCCGTGCTCGTGGTATATGATAATTCCGACCGCCCTTCCGGCATTCCCGAACGGTTTAGT
GGTTCAAATTCAGGCACCACAGCAACTCTGACCATAAGCAGAGTCGAAGCTGGAGACGAAG
CCGACTACTACTGTCAGGTATGGGACTCTAGTAGTGACCACCCTGTCGTCTTCGGTGGGGGA
ACCAAAGTGACCGTTCTGGGCGGCTCCGAGGGCAAGAGCAGCGGCAGCGGCAGCGAGAGC
AAGAGCACCGGCGGCAGCCAGGTCCAGCTCGTAGAAAGTGGGGGCGGCGTAGTTCAGCCAG
GCAGGAGTCTCCGGCTGAGTTGTGCAGCCAGCGGCTTTACTTTTTCCTACTATGGAATGCACT
GGGTACGTCAGGCACCCGGCAAAGGTTTGGAGTGGGTCGCATTCATTTCTTATGATGGATCA
AATAAGTATTATGCCGATAGTGTAAAGGGCAGATTTACAATAAGTCGAGACAACTCAAAGA
ACACTCTCTACCTCCAAATGAATAGTCTTCGGGCAGAGGATACTGCAGTGTACTATTGTGCT
CATCTTCCTTATTCCGGTTCTTACTGGGCATTCGATTATTGGGGGCAAGGGACACAAGTTACC
GTGTCTAGCGAGCCCAAATCTAGCGACAAAACTCACACATGTCCACCGTGCCCAGCACCTGA
AGCAGCAGGGGGACCGTCAGTCTTCCTCTTCCCCCCAAAACCCAAGGACACCCTCATGATCT
CCCGGACCCCTGAGGTCACATGCGTGGTGGTGAGCGTGAGCCACGAAGACCCTGAGGTCAA
GTTCAACTGGTACGTGGACGGCGTGGAGGTGCATAATGCCAAGACAAAGCCGCGGGAGGAG
CAGTACAACAGCACGTACCGTGTGGTCAGCGTCCTCACCGTCCTGCACCAGGACTGGCTGAA
TGGCAAGGAGTACAAGTGCAAGGTCTCCAACAAAGCCCTCCCAGCCCCCATCGAGAAAACC
ATCTCCAAAGCCAAAGGGCAGCCCCGAGAACCACAGGTGTACGTGCTGCCCCCATCCCGGG
AGGAGATGACCAAGAACCAGGTCAGCCTGCTGTGCCTGGTCAAAGGCTTCTATCCCAGCGA
CATCGCCGTGGAGTGGGAGAGCAATGGGCAGCCGGAGAACAACTACCTCACCTGGCCTCCC
GTGCTGGACTCCGACGGCTCCTTCTTCCTCTACAGCAAGCTCACCGTGGACAAGTCTAGATG
GCAGCAGGGGAACGTCTTCTCATGCTCCGTGATGCATGAGGCTCTGCACAACCACTACACGC
AGAAGAGCCTCTCCCTGTCTCCGGGT (KL2B494-LH-scFv-Fc)

SEQ ID NO: 338

AGCAGCGAATTGACCCAACCACCTTCCGTCAGCGTCGCACCAGGGCAAACCGCCCGCATCA
CATGCGGTGGGAACAATATAGGAAGCAAATCTGTCCACTGGTACCAGCAAAAACCAGGACA
AGCCCCTGTTCTGGTCGTCTATGATGACAGCGACAGACCAAGTGGTATTCCCGAGAGATTCT
CCGGTAGCAACTCTGGAAATACAGCTACTTTGACCATCTCCAGAGTTGAGGCTGGTGACGAG
GCAGATTACTATTGCCAGGTCTGGGACAGCTCCAGCGACCACGTCGTATTCGGTGGCGGGAC
CAAGCTGACTGTGCTGGGCGGCTCCGAGGGCAAGAGCAGCGGCAGCGGCAGCGAGAGCAA
GAGCACCGGCGGCAGCCAGGTGCAGTTGGTAGAGTCAGGAGGGGGCCTCGTTCAACCTGGT
GGCAGCCTCCGTTTGTCTTGTGCTGCCAGTGGATTTACTTTCAGTCACTACGCAATGAGCTGG
GTGAGACAAGCACCTGGCAAGGGCCTTGAGTGGGTCTCCACTATCGGCGGTTCAGGGGGGA
GCACTTACTACGCTGACTCTGTAAAAGGTCGCTTTACTATATCTAGAGATAACTCTAAAAAC
ACACTCTACTTGCAGATGAACAGCCTGCGAGCCGAAGATACAGCCGTGTACTACTGCGCCAA
GCCTCATATTGTAATGGTCACTGCCCTCTTGTATGATGGCATGGATGTTTGGGGCCAAGGGA
CAATGGTGACAGTCTCAAGCGAGCCCAAATCTAGCGACAAAACTCACACATGTCCACCGTG
CCCAGCACCTGAAGCAGCAGGGGGACCGTCAGTCTTCCTCTTCCCCCCAAAACCCAAGGACA
CCCTCATGATCTCCCGGACCCCTGAGGTCACATGCGTGGTGGTGAGCGTGAGCCACGAAGAC
CCTGAGGTCAAGTTCAACTGGTACGTGGACGGCGTGGAGGTGCATAATGCCAAGACAAAGC
CGCGGGAGGAGCAGTACAACAGCACGTACCGTGTGGTCAGCGTCCTCACCGTCCTGCACCA
GGACTGGCTGAATGGCAAGGAGTACAAGTGCAAGGTCTCCAACAAAGCCCTCCCAGCCCCC
ATCGAGAAAACCATCTCCAAAGCCAAAGGGCAGCCCCGAGAACCACAGGTGTACGTGCTGC
CCCCATCCCGGGAGGAGATGACCAAGAACCAGGTCAGCCTGCTGTGCCTGGTCAAAGGCTT
CTATCCCAGCGACATCGCCGTGGAGTGGGAGAGCAATGGGCAGCCGGAGAACAACTACCTC
ACCTGGCCTCCCGTGCTGGACTCCGACGGCTCCTTCTTCCTCTACAGCAAGCTCACCGTGGAC
AAGTCTAGATGGCAGCAGGGGAACGTCTTCTCATGCTCCGTGATGCATGAGGCTCTGCACAA
CCACTACACGCAGAAGAGCCTCTCCCTGTCTCCGGGT (KLK2B30 Fab HC cDNA)

SEQ ID NO: 335

CAGGTTCAACTTCAAGAATCCGGGCCAGGTCTGGTCAAGCCTTCAGAGACTTTGTCCCTTAC
TTGCACAGTGAGCGGTGGCTCTATCTCAAGTTACTACTGGTCATGGATACGGCAGCCCCCAG
GAAAGGGGCTTGAGTGGATTGGGTACATTTATTACTCAGGGTCAACAAACTACAATCCCTCC
CTCAAATCCCGAGTGACAATTAGTGTCGATACATCTAAAAACCAGTTTTCCCTGAAATTGAG
CTCAGTCACCGCAGCTGATACTGCAGTCTATTATTGTGCTGGCACAACAATCTTCGGGGTAG
TAACTCCAAACTTCTACTACGGGATGGACGTGTGGGGGCAAGGAACAACCGTAACAGTAAG
TAGTGCCTCCACCAAGGGCCCATCGGTCTTCCCCCTGGCACCCTCCTCCAAGAGCACCTCTG

TABLE 39-continued

HC and LC DNA SEQ ID NOs of hK2/CD3 bispecific antibodies

GGGGCACAGCGGCCCTGGGCTGCCTGGTCAAGGACTACTTCCCCGAACCGGTGACGGTGTC
GTGGAACTCAGGCGCCCTGACCAGCGGCGTGCACACCTTCCCGGCTGTCCTACAGTCCTCAG
GACTCTACTCCCTCAGCAGCGTGGTGACCGTGCCCTCCAGCAGCTTGGGCACCCAGACCTAC
ATCTGCAACGTGAATCACAAGCCCAGCAACACCAAGGTGGACAAGAAAGTTGAGCCCAAAT
CTTGTGACAAAACTCACACATGTCCACCGTGCCCAGCACCTGAAGCAGCAGGGGGACCGTC
AGTCTTCCTCTTCCCCCCAAAACCCAAGGACACCCTCATGATCTCCCGGACCCCTGAGGTCA
CATGCGTGGTGGTGAGCGTGAGCCACGAAGACCCTGAGGTCAAGTTCAACTGGTACGTGGA
CGGCGTGGAGGTGCATAATGCCAAGACAAAGCCGCGGGAGGAGCAGTACAACAGCACGTA
CCGTGTGGTCAGCGTCCTCACCGTCCTGCACCAGGACTGGCTGAATGGCAAGGAGTACAAGT
GCAAGGTCTCCAACAAAGCCCTCCCAGCCCCCATCGAGAAAACCATCTCCAAAGCCAAAGG
GCAGCCCCGAGAACCACAGGTGTACGTGCTGCCCCCATCCCGGGAGGAGATGACCAAGAAC
CAGGTCAGCCTGCTGTGCCTGGTCAAAGGCTTCTATCCCAGCGACATCGCCGTGGAGTGGGA
GAGCAATGGGCAGCCGGAGAACAACTACCTCACCTGGCCTCCCGTGCTGGACTCCGACGGC
TCCTTCTTCCTCTACAGCAAGCTCACCGTGGACAAGTCTAGATGGCAGCAGGGGAACGTCTT
CTCATGCTCCGTGATGCATGAGGCTCTGCACAACCACTACACGCAGAAGAGCCTCTCCCTGT
CTCCGGGT (KLK2B30 Fab LC cDNA)

SEQ ID NO: 722

GATATTCAAATGACCCAGTCACCATCATTCCTGTCCGCCTCAGTGGGAGATCGCGTCACTAT
TACTTGTCGTGCTAGCCAGGGGATATCATCATATTTGGCTTGGTATCAACAAAAGCCAGGAA
AGGCCCCAAAATTCCTTATATATGCAGCTAGTACACTCCAGAGTGGTGTTCCTAGCCGGTTC
TCTGGCAGCGGCTCAGGGACCGAGTTCACCCTGACAATCTCCAGCTTGCAGCCCGAAGACTT
TGCAACCTACTATTGCCAGCAACTGAACTCCTATCCTCTGACTTTCGGGGGAGGAACCAAGG
TTGAGATTAAACGGACAGTGGCCGCTCCTTCCGTGTTCATCTTCCCACCTTCCGACGAGCAG
CTGAAGTCCGGCACAGCTTCTGTCGTGTGCCTGCTGAACAACTTCTACCCTCGGGAAGCCAA
GGTGCAGTGGAAGGTGGACAATGCCCTGCAGTCCGGCAACTCCCAAGAGTCTGTGACCGAG
CAGGACTCCAAGGACAGCACCTACAGCCTGTCCTCCACACTGACCCTGTCCAAGGCCGACTA
CGAGAAGCACAAGGTGTACGCCTGCGAAGTGACCCATCAGGGCCTGTCTAGCCCTGTGACC
AAGTCTTTCAACCGGGGCGAGTGT (KL2B53 Fab HC cDNA)

SEQ ID NO: 337

GAGGTACAACTTGTCGAAAGTGGCGGTGGAGTCGTCCAGCCTGGGCGATCACTTCGCCTCTC
CTGTGTAGCCTCTGGTTTCACTTTCTCATCTTACGACATACACTGGGTCCGCCAGGCACCTGG
TAAGGGGCTGGAGTGGGTTGCCATCATTAGTTACGATGGCTCCAAAAAAGATTACACCGATA
GCGTAAAGGGCAGATTTACCATTTCCAGGGATAATTCAAAGAACACCCTGTATCTGCAAATG
GACAGCCTCCGCGTCGAAGACTCTGCAGTTTATAGCTGTGCCAGGGAGTCAGGCTGGTCCCA
TTATTACTATTATGGTATGGACGTTTGGGGCCAGGGAACCATGGTCACTGTTAGTTCAGCCTC
CACCAAGGGCCCATCGGTCTTCCCCCTGGCACCCTCCTCCAAGAGCACCTCTGGGGGCACAG
CGGCCCTGGGCTGCCTGGTCAAGGACTACTTCCCCGAACCGGTGACGGTGTCGTGGAACTCA
GGCGCCCTGACCAGCGGCGTGCACACCTTCCCGGCTGTCCTACAGTCCTCAGGACTCTACTC
CCTCAGCAGCGTGGTGACCGTGCCCTCCAGCAGCTTGGGCACCCAGACCTACATCTGCAACG
TGAATCACAAGCCCAGCAACACCAAGGTGGACAAGAAAGTTGAGCCCAAATCTTGTGACAA
AACTCACACATGTCCACCGTGCCCAGCACCTGAAGCAGCAGGGGGACCGTCAGTCTTCCTCT
TCCCCCCAAAACCCAAGGACACCCTCATGATCTCCCGGACCCCTGAGGTCACATGCGTGGTG
GTGAGCGTGAGCCACGAAGACCCTGAGGTCAAGTTCAACTGGTACGTGGACGGCGTGGAGG
TGCATAATGCCAAGACAAAGCCGCGGGAGGAGCAGTACAACAGCACGTACCGTGTGGTCAG
CGTCCTCACCGTCCTGCACCAGGACTGGCTGAATGGCAAGGAGTACAAGTGCAAGGTCTCCA
ACAAAGCCCTCCCAGCCCCCATCGAGAAAACCATCTCCAAAGCCAAAGGGCAGCCCCGAGA
ACCACAGGTGTACGTGCTGCCCCCATCCCGGGAGGAGATGACCAAGAACCAGGTCAGCCTG
CTGTGCCTGGTCAAAGGCTTCTATCCCAGCGACATCGCCGTGGAGTGGGAGAGCAATGGGC
AGCCGGAGAACAACTACCTCACCTGGCCTCCCGTGCTGGACTCCGACGGCTCCTTCTTCCTCT
ACAGCAAGCTCACCGTGGACAAGTCTAGATGGCAGCAGGGGAACGTCTTCTCATGCTCCGTG
ATGCATGAGGCTCTGCACAACCACTACACGCAGAAGAGCCTCTCCCTGTCTCCGGGT (KL2B53 Fab LC cDNA)

SEQ ID NO: 723

GATATTGTAATGACTCAGTCACCCTCTTCACTGAGTGCATCAGTAGGTGATCGCGTTACCATC
ACTTGCCGTGCCAGTCAAGACATTTCAAATTACCTTGCATGGTACCAACAAAAGCCCGGAAA
AGTGCCAAAGTTTTTGATTTATGCCGCTTCAACACTCCATTCAGGAGTGCCCTCTCGTTTCAG
TGGATCTGGCAGTGGCACCGATTTTACTCTCACAATAAGCAGTCTCCAGCCTGAGGATGTAG
CCACCTATTATTGCCAAAAATATAATTCAGCCCCCTATACTTTTGGACAGGGCACACGCCTT
GAGATTAAACGGACAGTGGCCGCTCCTTCCGTGTTCATCTTCCCACCTTCCGACGAGCAGCT
GAAGTCCGGCACAGCTTCTGTCGTGTGCCTGCTGAACAACTTCTACCCTCGGGAAGCCAAGG
TGCAGTGGAAGGTGGACAATGCCCTGCAGTCCGGCAACTCCCAAGAGTCTGTGACCGAGCA
GGACTCCAAGGACAGCACCTACAGCCTGTCCTCCACACTGACCCTGTCCAAGGCCGACTACG
AGAAGCACAAGGTGTACGCCTGCGAAGTGACCCATCAGGGCCTGTCTAGCCCTGTGACCAA
GTCTTTCAACCGGGGCGAGTGT (KLK2B242 Fab HC cDNA and KL2B242LC_C33S Fab HC)

SEQ ID NO: 336

CAAGTACAACTTCAAGAGTCTGGCCCTGGGCTTGTTAAGCCCTCAGAGACCTTGTCACTGAC
CTGTACCGTATCAGGCGGGTCAATTTCATCTTACTACTGGAGTTGGCTTCGTCAGCCTGCCGG
ATCTGGACTGGAGTGGATAGGTAGACTGTATGTTTCCGGCTTTACAAATTACAACCCATCTTT
GAAAAGCCGTGTGACTCTCAGCCTCGACCCTTCTCGGAATCAACTTTCACTTAAATTGTCTTC
TGTTACAGCTGCCGACACTGCAGTATATTATTGTGCAGGGGACTCAGGCAACTATTGGGGAT
GGTTTGATCCTTGGGGGCAGGGGACCCTGGTAACCGTGAGTTCTGCCTCCACCAAGGGCCCA

TABLE 39-continued

| HC and LC DNA SEQ ID NOs of hK2/CD3 bispecific antibodies |
|---|

TCGGTCTTCCCCCTGGCACCCTCCTCCAAGAGCACCTCTGGGGGCACAGCGGCCCTGGGCTG
CCTGGTCAAGGACTACTTCCCCGAACCGGTGACGGTGTCGTGGAACTCAGGCGCCCTGACCA
GCGGCGTGCACACCTTCCCGGCTGTCCTACAGTCCTCAGGACTCTACTCCCTCAGCAGCGTG
GTGACCGTGCCCTCCAGCAGCTTGGGCACCCAGACCTACATCTGCAACGTGAATCACAAGCC
CAGCAACACCAAGGTGGACAAGAAAGTTGAGCCCAAATCTTGTGACAAAACTCACACATGT
CCACCGTGCCCAGCACCTGAAGCAGCAGGGGGACCGTCAGTCTTCCTCTTCCCCCCAAAACC
CAAGGACACCCTCATGATCTCCCGGACCCCTGAGGTCACATGCGTGGTGGTGAGCGTGAGCC
ACGAAGACCCTGAGGTCAAGTTCAACTGGTACGTGGACGGCGTGGAGGTGCATAATGCCAA
GACAAAGCCGCGGGAGGAGCAGTACAACAGCACGTACCGTGTGGTCAGCGTCCTCACCGTC
CTGCACCAGGACTGGCTGAATGGCAAGGAGTACAAGTGCAAGGTCTCCAACAAAGCCCTCC
CAGCCCCCATCGAGAAAACCATCTCCAAAGCCAAAGGGCAGCCCCGAGAACCACAGGTGTA
CGTGCTGCCCCCATCCCGGGAGGAGATGACCAAGAACCAGGTCAGCCTGCTGTGCCTGGTCA
AAGGCTTCTATCCCAGCGACATCGCCGTGGAGTGGGAGAGCAATGGGCAGCCGGAGAACAA
CTACCTCACCTGGCCTCCCGTGCTGGACTCCGACGGCTCCTTCTTCCTCTACAGCAAGCTCAC
CGTGGACAAGTCTAGATGGCAGCAGGGGAACGTCTTCTCATGCTCCGTGATGCATGAGGCTC
TGCACAACCACTACACGCAGAAGAGCCTCTCCCTGTCTCCGGGT (KLK2B242LC_C33S Fab LC cDNA)

SEQ ID NO: 360

AGTTATGAGCTGACTCAACCACCCAGTGTCAGCGTATCCCCAGGAGAAACTGCCTCTATAAC
ATGCAGCGGAGACCAGTTGGGAGAAAATTACGCCTCCTGGTACCAACAGAAGCCTGGACAA
AGTCCTGTCCTCGTTATTTATCAAGATTCTAAACGTCCCTCTGGGATCCCCGAACGATTCTCC
GGCTCTAACTCTGGGAATACCGCTACCTTGACAATAAGTGGTACACAGGCACTTGATGAAGC
TGATTATTACTGCCAGGCATGGGATAACAGCATTGTGGTTTTCGGGGGCGGCACCAAACTCA
CAGTTCTCGGTCAGCCCAAGGCTGCACCCAGTGTCACTCTGTTCCCGCCCTCCTCTGAGGAG
CTTCAAGCCAACAAGGCCACACTGGTGTGTCTCATAAGTGACTTCTACCCGGGAGCCGTGAC
AGTGGCCTGGAAGGCCGATAGCAGCCCCGTCAAGGCGGGAGTGGAGACCACCACACCCTCC
AAACAAAGCAACAACAAGTACGCGGCCAGCAGCTATCTGAGCCTGACGCCTGAGCAGTGGA
AGTCCCACAGAAGCTACAGCTGCCAGGTCACGCATGAAGGGAGCACCGTGGAGAAGACAGT
GGCCCCTACAGAATGTTCA (KLK2B30 wK477 Fab HC cDNA)

SEQ ID NO: 339

CAGGTTCAGCTGCAAGAGTCTGGCCCTGGCCTGGTCAAGCCTTCCGAGACACTGTCTCTGAC
CTGCACCGTGTCTGGCGGCTCCATCTCCTCCTACTACTGGTCCTGGATCAGACAGCCTCCTGG
CAAAGGCCTGGAATGGATCGGCTACATCTACTACTCCGGCTCCACCAACTACAACCCCAGCC
TGAAGTCCAGAGTGACCATCTCCGTGGACACCTCCAAGAACCAGTTCTCCCTGAAGCTGTCC
TCCGTGACCGCTGCTGATACCGCCGTGTACTATTGTGCTGGCACCACCATCTTCGGCGTGGTC
ACCCCTAACTTCTACTACGGCATGGACGTGTGGGGCCAAGGCACAACAGTGACAGTCTCTTC
TGCCTCCACCAAGGGTCCATCGGTCTTCCCCCTGGCACCCTCCTCCAAGAGCACCTCTGGGG
GCACAGCGGCCCTGGGCTGCCTGGTCAAGGACTACTTCCCCGAACCGGTGACGGTGTCGTGG
AACTCAGGCGCCCTGACCAGCGGCGTGCACACCTTCCCGGCTGTCCTACAGTCCTCAGGACT
CTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAAAGTTGAGCCCAAATCTTG
TGACAAAACTCACACTTGTCCACCGTGCCCAGCACCTGAAGCAGCAGGGGGACCGTCAGTCT
TCCTCTTCCCCCCAAAACCCAAGGACACCCTCATGATCTCCCGGACCCCTGAGGTCACATGC
GTGGTGGTGAGCGTGAGCCACGAAGACCCTGAGGTCAAGTTCAACTGGTACGTGGACGGCG
TGGAGGTGCATAATGCCAAGACAAAGCCGCGGGAGGAGCAGTACAACAGCACGTACCGTGT
GGTCAGCGTCCTCACCGTCCTGCACCAGGACTGGCTGAATGGCAAGGAGTACAAGTGCAAG
GTGTCCAACAAAGCCCTCCCAGCCCCCATCGAGAAAACCATCTCCAAAGCCAAAGGGCAGC
CCCGAGAACCACAGGTGTACGTGCTGCCCCCATCCCGGGAGGAGATGACCAAGAACCAGGT
CAGCCTGCTGTGCCTGGTCAAAGGCTTCTATCCCAGCGACATCGCCGTGGAGTGGGAGAGCA
ATGGGCAGCCGGAGAACAACTACCTCACCTGGCCTCCCGTGCTGGACTCCGACGGCTCCTTC
TTCCTCTACAGCAAGCTCACCGTGGACAAGTCCAGATGGCAGCAGGGGAACGTCTTCTCATG
CTCCGTGATGCATGAGGCTCTGCACAACCACTACACGCAGAAGTCTCTCTCCCTGTCTCCGG
GAAAA (CD3W245-LH-scFv-Fc cDNA)

SEQ ID NO: 353

GACATACAAATGACACAATCACCCTCTTCTCTTTCTGCAAGCGTTGGCGACCGTGTCACTATC
ACTTGTCGAGCCCGCCAGTCCATAGGTACTGCCATTCACTGGTATCAACAGAAGCCTGGCAA
GGCTCCCAAACTCCTGATTAAGTATGCCAGCGAGAGCATTTCCGGCGTACCTTCAAGATTTT
CCGGCTCCGGTAGTGGGACAGATTTCACTCTCACTATATCTAGCCTCCAACCAGAAGATTTC
GCCACTTACTACTGTCAACAATCAGGTTCATGGCCTTACACTTTCGGCCAGGGGACAAAATT
GGAGATCAAGGGCGGCTCCGAGGGCAAGAGCAGCGGCAGCGGCAGCGAGAGCAAGAGCAC
CGGCGGCAGCGAGGTGCAACTGGTGGAGTCTGGGGGAGGCCTGGTCAAGCCTGGGGGGTCC
CTGAGACTCTCCTGTGCAGCCTCTGGATTCACCTTCAGTAGATATAACATGAACTGGGTCCG
CCAGGCTCCAGGGAAGGGGCTGGAGTGGGTCTCATCCATTAGTACTAGTAGTAATTACATAT
ACTACGCAGACTCAGTGAAGGGCCGATTCACCTTCTCCAGAGACAACGCCAAGAACTCACT
GGATCTGCAAATGAGCGGCCTGAGAGCCGAGGACACGGCTATTTATTACTGTACGAGAGGC
TGGGGGCCTTTTGACTACTGGGGCCAGGGAACCCTGGTCACCGTCTCCTCAGAGCCCAAATC
TAGCGACAAAACTCACACATGTCCACCGTGCCCAGCACCTGAAGCAGCAGGGGGACCGTCA
GTCTTCCTCTTCCCCCCAAAACCCAAGGACACCCTCATGATCTCCCGGACCCCTGAGGTCAC
ATGCGTGGTGGTGAGCGTGAGCCACGAAGACCCTGAGGTCAAGTTCAACTGGTACGTGGAC
GGCGTGGAGGTGCATAATGCCAAGACAAAGCCGCGGGAGGAGCAGTACAACAGCACGTAC
CGTGTGGTCAGCGTCCTCACCGTCCTGCACCAGGACTGGCTGAATGGCAAGGAGTACAAGTG
CAAGGTCTCCAACAAAGCCCTCCCAGCCCCCATCGAGAAAACCATCTCCAAAGCCAAAGGG
CAGCCCCGAGAACCACAGGTGTACGTGTACCCCCCATCCCGGGAGGAGATGACCAAGAACC

TABLE 39-continued

HC and LC DNA SEQ ID NOs of hK2/CD3 bispecific antibodies

AGGTCAGCCTGACCTGCCTGGTCAAAGGCTTCTATCCCAGCGACATCGCCGTGGAGTGGGAG
AGCAATGGGCAGCCGGAGAACAACTACAAGACCACGCCTCCCGTGCTGGACTCCGACGGCT
CCTTCGCCCTCGTGAGCAAGCTCACCGTGGACAAGTCTAGATGGCAGCAGGGGAACGTCTTC
TCATGCTCCGTGATGCATGAGGCTCTGCACAACCACTACACGCAGAAGAGCCTCTCCCTGTC
TCCGGGT (CD3W245-LH-scFv-Fc w/ K447)

SEQ ID NO: 354

GACATCCAGATGACCCAGTCTCCATCCTCTCTGTCCGCCTCTGTGGGCGACAGAGTGACCAT
TACCTGCCGGGCCAGACAGTCTATCGGCACCGCTATCCACTGGTATCAGCAGAAGCCTGGCA
AGGCCCCTAAGCTGCTGATTAAGTACGCCTCCGAGTCCATCTCCGGCGTGCCCTCCAGATTTT
CTGGCTCTGGATCTGGCACCGACTTTACCCTGACAATCTCCAGCCTGCAGCCTGAGGACTTC
GCCACCTACTACTGTCAGCAGTCCGGCTCTTGGCCTTACACCTTTGGTCAGGGCACCAAGCT
GGAAATCAAGGGCGGATCTGAGGGAAAGTCCAGCGGCTCCGGCAGCGAAAGCAAGTCCACC
GGCGGAAGCGAGGTGCAGCTGGTTGAATCTGGCGGAGGACTGGTTAAGCCTGGCGGCTCTC
TGAGACTGTCTTGTGCTGCTTCTGGCTTCACCTTCAGCCGGTACAACATGAACTGGGTCCGAC
AGGCTCCTGGCAAAGGCCTGGAATGGGTGTCCTCCATCTCCACCTCCAGCAACTACATCTAC
TACGCCGACTCCGTGAAGGGCAGATTCACCTTCTCCAGAGACAACGCCAAGAACTCCCTGGA
CCTGCAGATGTCTGGCCTGAGAGCTGAGGACACCGCTATCTACTACTGCACCAGAGGCTGGG
GACCCTTCGATTATTGGGGCCAGGGAACCCTGGTCACCGTGTCATCTGAGCCCAAATCTAGC
GACAAAACTCACACTTGTCCACCGTGCCCAGCACCTGAAGCAGCAGGGGGACCGTCAGTCTT
CCTCTTCCCCCCAAAACCCAAGGACACCCTCATGATCTCCCGGACCCCTGAGGTCACATGCG
TGGTGGTGAGCGTGAGCCACGAAGACCCTGAGGTCAAGTTCAACTGGTACGTGGACGGCGT
GGAGGTGCATAATGCCAAGACAAAGCCGCGGGAGGAGCAGTACAACAGCACGTACCGTGTG
GTCAGCGTCCTCACCGTCCTGCACCAGGACTGGCTGAATGGCAAGGAGTACAAGTGCAAGG
TGTCCAACAAAGCCCTCCCAGCCCCCATCGAGAAAACCATCTCCAAAGCCAAAGGGCAGCC
CCGAGAACCACAGGTGTACGTGTACCCCCCATCCCGGGAGGAGATGACCAAGAACCAGGTC
AGCCTGACCTGCCTGGTCAAAGGCTTCTATCCCAGCGACATCGCCGTGGAGTGGGAGAGCA
ATGGGCAGCCGGAGAACAACTACAAGACCACGCCTCCCGTGCTGGACTCCGACGGCTCCTTC
GCCCTCGTGAGCAAGCTCACCGTGGACAAGTCCAGATGGCAGCAGGGGAACGTCTTCTCAT
GCTCCGTGATGCATGAGGCTCTGCACAACCACTACACGCAGAAGTCTCTCTCCCTGTCTCCG
GGAAAA (CD3W245 Fab-HC-Fc)

SEQ ID NO: 725

GAGGTGCAACTGGTGGAGTCTGGGGGAGGCCTGGTCAAGCCTGGGGGGTCCCTGAGACTCT
CCTGTGCAGCCTCTGGATTCACCTTCAGTAGATATAACATGAACTGGGTCCGCCAGGCTCCA
GGGAAGGGGCTGGAGTGGGTCTCATCCATTAGTACTAGTAGTAATTACATATACTACGCAGA
CTCAGTGAAGGGCCGATTCACCTTCTCCAGAGACAACGCCAAGAACTCACTGGATCTGCAAA
TGAGCGGCCTGAGAGCCGAGGACACGGCTATTTATTACTGTACGAGAGGCTGGGGGCCTTTT
GACTACTGGGGCCAGGGAACCCTGGTCACCGTCTCCTCAGCCTCCACCAAGGGCCCATCGGT
CTTCCCCCTGGCACCCTCCTCCAAGAGCACCTCTGGGGGCACAGCGGCCCTGGGCTGCCTGG
TCAAGGACTACTTCCCCGAACCGGTGACGGTGTCGTGGAACTCAGGCGCCCTGACCAGCGGC
GTGCACACCTTCCCGGCTGTCCTACAGTCCTCAGGACTCTACTCCCTCAGCAGCGTGGTGAC
CGTGCCCTCCAGCAGCTTGGGCACCCAGACCTACATCTGCAACGTGAATCACAAGCCCAGCA
ACACCAAGGTGGACAAGAAAGTTGAGCCCAAATCTTGTGACAAAACTCACACATGTCCACC
GTGCCCAGCACCTGAAGCAGCAGGGGGACCGTCAGTCTTCCTCTTCCCCCCAAAACCCAAGG
ACACCCTCATGATCTCCCGGACCCCTGAGGTCACATGCGTGGTGGTGAGCGTGAGCCACGAA
GACCCTGAGGTCAAGTTCAACTGGTACGTGGACGGCGTGGAGGTGCATAATGCCAAGACAA
AGCCGCGGGAGGAGCAGTACAACAGCACGTACCGTGTGGTCAGCGTCCTCACCGTCCTGCA
CCAGGACTGGCTGAATGGCAAGGAGTACAAGTGCAAGGTCTCCAACAAAGCCCTCCCAGCC
CCCATCGAGAAAACCATCTCCAAAGCCAAAGGGCAGCCCCGAGAACCACAGGTGTACGTGT
ACCCCCCATCCCGGGAGGAGATGACCAAGAACCAGGTCAGCCTGACCTGCCTGGTCAAAGG
CTTCTATCCCAGCGACATCGCCGTGGAGTGGGAGAGCAATGGGCAGCCGGAGAACAACTAC
AAGACCACGCCTCCCGTGCTGGACTCCGACGGCTCCTTCGCCCTCGTGAGCAAGCTCACCGT
GGACAAGTCTAGATGGCAGCAGGGGAACGTCTTCTCATGCTCCGTGATGCATGAGGCTCTGC
ACAACCACTACACGCAGAAGAGCCTCTCCCTGTCTCCGGGT (CD3W245 Fab-LC-Fc)

SEQ ID NO: 726

GACATACAAATGACACAATCACCCTCTTCTCTTTCTGCAAGCGTTGGCGACCGTGTCACTATC
ACTTGTCGAGCCCGCCAGTCCATAGGTACTGCCATTCACTGGTATCAACAGAAGCCTGGCAA
GGCTCCCAAACTCCTGATTAAGTATGCCAGCGAGAGCATTTCCGGCGTACCTTCAAGATTTT
CCGGCTCCGGTAGTGGGACAGATTTCACTCTCACTATATCTAGCCTCCAACCAGAAGATTTC
GCCACTTACTACTGTCAACAATCAGGTTCATGGCCTTACACTTTCGGCCAGGGGACAAAATT
GGAGATCAAGCGGACAGTGGCCGCTCCTTCCGTGTTCATCTTCCCACCTTCCGACGAGCAGC
TGAAGTCCGGCACAGCTTCTGTCGTGTGCCTGCTGAACAACTTCTACCCTCGGGAAGCCAAG
GTGCAGTGGAAGGTGGACAATGCCCTGCAGTCCGGCAACTCCCAAGAGTCTGTGACCGAGC
AGGACTCCAAGGACAGCACCTACAGCCTGTCCTCCACACTGACCCTGTCCAAGGCCGACTAC
GAGAAGCACAAGGTGTACGCCTGCGAAGTGACCCATCAGGGCCTGTCTAGCCCTGTGACCA
AGTCTTTCAACCGGGGCGAGTGT (CD3B376 Fab-HC-Fc)

SEQ ID NO: 351

CAGGTGCAGCTCCAACAGAGTGGTCCCAGACTCGTGAGACCCTCTCAAACACTCAGTTTGAC
TTGTGCCATCTCAGGCGATTCAGTTTTCAACAACAATGCAGCTTGGAGCTGGATTAGGCAGT
CACCTAGTCGCGGTCTTGAATGGCTTGGGCGTACATACTATCGCTCTAAATGGTTGTATGATT
ACGCTGTGTCCGTGAAGAGCCGAATCACCGTAAACCCTGATACCTCCAGGAATCAGTTCACA

TABLE 39-continued

| HC and LC DNA SEQ ID NOs of hK2/CD3 bispecific antibodies |
|---|
| TTGCAACTGAATAGTGTGACTCCCGAGGATACTGCACTCTATTATTGTGCCCGAGGATATAG CAGTAGCTTCGACTATTGGGGACAAGGGACACTCGTTACCGTTAGTTCAGCCTCCACCAAGG GCCCATCGGTCTTCCCCCTGGCACCCTCCTCCAAGAGCACCTCTGGGGGCACAGCGGCCCTG GGCTGCCTGGTCAAGGACTACTTCCCCGAACCGGTGACGGTGTCGTGGAACTCAGGCGCCCT GACCAGCGGCGTGCACACCTTCCCGGCTGTCCTACAGTCCTCAGGACTCTACTCCCTCAGCA GCGTGGTGACCGTGCCCTCCAGCAGCTTGGGCACCCAGACCTACATCTGCAACGTGAATCAC AAGCCCAGCAACACCAAGGTGGACAAGAAAGTTGAGCCCAAATCTTGTGACAAAACTCACA CATGTCCACCGTGCCCAGCACCTGAAGCAGCAGGGGGACCGTCAGTCTTCCTCTTCCCCCCA AAACCCAAGGACACCCTCATGATCTCCCGGACCCCTGAGGTCACATGCGTGGTGGTGAGCGT GAGCCACGAAGACCCTGAGGTCAAGTTCAACTGGTACGTGGACGGCGTGGAGGTGCATAAT GCCAAGACAAAGCCGCGGGAGGAGCAGTACAACAGCACGTACCGTGTGGTCAGCGTCCTCA CCGTCCTGCACCAGGACTGGCTGAATGGCAAGGAGTACAAGTGCAAGGTCTCCAACAAAGC CCTCCCAGCCCCCATCGAGAAAACCATCTCCAAAGCCAAAGGGCAGCCCCGAGAACCACAG GTGTACGTGTACCCCCCATCCCGGGAGGAGATGACCAAGAACCAGGTCAGCCTGACCTGCCT GGTCAAAGGCTTCTATCCCAGCGACATCGCCGTGGAGTGGGAGAGCAATGGGCAGCCGGAG AACAACTACAAGACCACGCCTCCCGTGCTGGACTCCGACGGCTCCTTCGCCCTCGTGAGCAA GCTCACCGTGGACAAGTCTAGATGGCAGCAGGGGAACGTCTTCTCATGCTCCGTGATGCATG AGGCTCTGCACAACCACTACACGCAGAAGAGCCTCTCCCTGTCTCCGGGT |
| (CD3B376 Fab-LC-Fc) SEQ ID NO: 352 |
| CAGTCTGCTCTGACCCAGCCTGCCTCCGTGTCTGGCTCTCCCGGCCAGTCCATCACCATCAGC TGTACCGGCACCTCCTCCAACATCGGCACCTACAAGTTCGTGTCCTGGTATCAGCAGCACCC CGACAAGGCCCCCAAAGTGCTGCTGTACGAGGTGTCCAAGCGGCCCTCTGGCGTGTCCTCCA GATTCTCCGGCTCCAAGTCTGGCAACACCGCCTCCCTGACCATCAGCGGACTGCAGGCTGAG GACCAGGCCGACTACCACTGTGTGTCCTACGCTGGCTCTGGCACCCTGCTGTTTGGCGGAGG CACCAAGCTGACCGTGCTGGGTCAGCCCAAGGCTGCACCCAGTGTCACTCTGTTCCCGCCCT CCTCTGAGGAGCTTCAAGCCAACAAGGCCACACTGGTGTGTCTCATAAGTGACTTCTACCCG GGAGCCGTGACAGTGGCCTGGAAGGCCGATAGCAGCCCCGTCAAGGCGGGAGTGGAGACCA CCACACCCTCCAAACAAAGCAACAACAAGTACGCGGCCAGCAGCTATCTGAGCCTGACGCC TGAGCAGTGGAAGTCCCACAGAAGCTACAGCTGCCAGGTCACGCATGAAGGGAGCACCGTG GAGAAGACAGTGGCCCCTACAGAATGTTCA |

Example 4: Biophysical Characterization of hK2×CD3 Bi-Specific Antibodies

Affinity of Selected hK2×CD3 Bispecific Antibodies

Affinity of selected hK2×CD3 bispecific antibodies to hK2 or human CD3 was measured by surface plasmon resonance (SPR). SPR is a label-free technique to study the strength of an interaction between two binding partners by measuring the change in mass upon complex formation and dissociation. Antibodies were captured on a sensor chip coated with an anti-Fc antibody followed by injection of soluble hK2 (or soluble recombinant CD3) at various concentrations and specified association and dissociation times. Post dissociation, the surface was regenerated with an appropriate solution to prepare for the next interaction. Kinetic information (on-rate and off-rate constants) were extracted by fitting sensorgrams to the 1:1 Langmuir model. Binding affinity (KD) are reported as the ratio of rate constants (koff/kon). KD values of selected hK2/CD3 bispecific antibodies are listed in Table 40.

TABLE 40

$K_D$ values of selected hK2/CD3 bispecific antibodies for the respective binding arms

| KLK2 arm | $K_D$ (nM) |
|---|---|
| KL2B467 Fab | 0.09 |
| KL2B494 Fab | 0.06 |
| KL2B359-LH-scFv | 0.63 |
| KL2B413-LH-scFv | 16.4 |

TABLE 40-continued $K_D$ values of selected hK2/CD3 bispecific antibodies for the respective binding arms

| KLK2 arm | $K_D$ (nM) |
|---|---|
| CD3B376 Fab | 20-40 |
| CD3W245 Fab | 0.14 |
| CD3W245 LH scFv | 20-30 |
| KL2B30 Fab | 2 |
| KL2853 Fab | 0.1 |
| KL2B242 Fab | 0.14 |

Thermal Stability of Selected hK2×CD3 Bispecific Antibodies

Thermal stability of the bispecific antibody samples was determined by NanoDSF method using an automated Prometheus instrument. Measurements were made by loading sample into 24 well capillary from a 384 well sample plate. Duplicate runs were performed for each sample. Prometheus NanoDSF user interface (Melting Scan tab) was used to set up the experimental parameters for the run. The thermal scans for the samples span from 20° C. to 95° C. at a rate of 1.0° C./minute. Dual-UV technology monitors intrinsic tryptophan and tyrosine fluorescence at the emission wavelengths of 330 nm and 350 nm, and this ratio (F350 nm/F330 nm) is plotted against temperature to generate an unfolding curve. Nano DSF is used for measuring Tm of all molecules at 0.5 mg/mL concentration in Phosphate Buffered Saline, pH 7.4. Measured Tm values are listed in Table 41.

TABLE 41

Tm values for KLK2 or CD3 binding arms of selected hK2 × CD3 bispecific antibodies.

| Molecule | Tm (° C.) by DSF |
|---|---|
| KL2B413 (scFv) | 67 |
| KL2B359 (scFv) | 67 |
| KL2B30 (Fab) | >70 |
| KL2B242 (Fab) | >70 |
| KL2B53 (Fab) | >70 |
| KL2B467 (Fab) | >70 |
| KL2B494 (Fab) | >70 |
| CD3B376 (Fab) | 61 |
| CD3W245 LH scFv | 66 |

Self-Association Potential by AC-SINS (Affinity Capture-Self Interaction Nanoparticle Spectroscopy)

A high throughput screening assay was used to measure the propensity of an Ab candidate to self-interact. Propensity for self-interaction usually translates into poor Ab solubility and challenges in downstream Ab manufacturing. In this assay, gold nanoparticles (AuNPs) were coated with goat anti-human IgG (H+L) capture antibody and later incubated with candidate Abs in the presence of polyclonal goat IgG. Any candidate Ab that self-associates brings the AuNPs into proximity, resulting in a shift of the nanoparticles' plasmon wavelength ($\lambda_p$), also referred to as the wavelength at maximum absorbance ($\lambda_{max}$). The magnitude of the shift ($\Delta\lambda_{max}$) for each candidate Ab is indicative of the strength of its self-association. Proper control antibodies which showed none to high self-association potential were used in this assay. All molecules tested in this assay showed none to low risks for self-association.

Example 5: In Vitro and In Vivo Characterization of Bispecific hK2×CD3 Antibodies In Vitro Cytotoxicity of hK2×CD3 Bi-Specific Antibodies The cytotoxicity potential of the generated bispecific antibodies was measured in vitro with a T-cell-mediated cytotoxicity assay using live-time lapse imaging on the Incucyte platform. The bispecific antibodies were tested in hK2 positive cell line VCaP cells, in the presence of isolated pan human $CD3^+$ T cells from healthy donors at a Effector: Target ratio (E:T ratio) of 3:1. Cell death by apoptosis was monitored by measuring the fluorescence signal from a dye which is stably expressed by target VCaP cells.

Normal donor pan T cells were co-incubated with KLK2+ VCaP cells. KLK2×CD3 bispecific antibodies were dosed from 0 to 100 nM for 96 hours. 3:1 Effector-to-Target (ET) ratio was used. (A) Target cells were stably expressing a red nuclear dye which was measured by IncuCyte imaging system in real-time for quantifying target cell death. Overall tumor cell lysis was graphed based on AUC of real-time kinetic killing curve of VCaP cells (FIG. 8A). Green fluorescent Caspase 3/7 reagent was used to measure apoptosis signal from target cell death. Total Caspase 3/7 activity was graphed based on AUC of real-time caspase 3/7 activity curve (FIG. 8B). The data showed that the bispecific hK2/CD3 antibodies tested promote a dose-dependent reduction of viable VCaP cells with increasing time and hence induce T cell mediated death of the VCaP tumor cells. Bispecific hK2×CD3 antibodies were effective at mediating T cell activation and show dose-dependent $KLK2^+$ tumor cell killing.

In Vitro T Cell Activation and Proliferation by hK2×CD3 Bi-Specific Molecules hK2×CD3 bispecific antibodies were tested for their ability to promote T cell activation and proliferation. Normal donor pan T cells were labelled with CFSE (5 uM) and co-cultured with KLK2 (+) VCap cells. KLK2×CD3 bispecific antibodies were dosed from 0 to 100 nM for 96 hours. 3:1 Effector-to-Target (ET) ratio was used. After 96 hours co-incubation, cells were harvested and stained with CD25, live/dead Dye. Flow cytometric analysis was performed on a Fortessa flow cytometer with Flowjo software. The frequencies of CTV dye dilution and activation marker CD25 were determined. The frequency of CD25 positive cells at different doses were used to graph in vitro T activation (FIG. 9A). The proliferation gate was determined using the 0 nM treatment group. The frequency of cells entered into proliferation gate was used to graph in vitro T cell proliferation (FIG. 9B). The data confirm dose dependent activation and proliferation of T cells by various KLK2×CD3 bi-specific antibodies.

In Vitro T Cell Cytokine Release by hK2×CD3 Bi-Specific Molecules.

The effect of anti-hK2×CD3 antibodies on T-cell cytokines release was measured in vitro. Supernatant samples were collected from the in vitro cytotoxicity experiment described above. A 13-plex cytokine Luminex assay was carried out to quantify IFN-γ and TNF-α concentrations at different doses of hK2×CD3 bispecific antibodies. FIGS. 10A and 10B show functional cytokine release by T cells triggered by KLK2×CD3 bi-specific antibodies in a dose-dependent manner.

Efficacy of Bispecific hK2×CD3 Antibodies in Established Subcutaneous (SC) Human Prostate Xenograph Model in T Cell Humanized Mice.

In vivo efficacy of KLK2×CD3 bispecifics was evaluated in human prostate tumor VCaP s.c. mouse xenograft model. The antitumor efficacy of KLK2×CD3 molecules was evaluated in established SC human prostate VCaP xenografts. Intact male NSG mice were used to provide a suitable host for engrafting human tumors and human T cells. The human prostate cell line VCaP was obtained from American Type Culture Collection (ATCC). VCaP cells were harvested during exponential growth and mice were injected with $1\times10^7$ cells SC in a volume of 0.2 mL in the right flank. 20e6 human T cells were injected i.p for each animal. Three dose levels were evaluated with 5-fold escalation: 0.2 mg/kg, 1 mg/kg and 5 mg/kg. Bispecific antibodies were dosed twice a week via i.p. Eye blood was sampled at 6 hours post first i.p dosing and functional cytokine levels were measured using Luminex based assays. Tumor volume and body weight measurements were collected twice weekly throughout all studies. The percent delta tumor growth inhibition (ΔTGI) was defined as the difference between mean tumor burden of the treated and control groups, calculated as % ΔTGI=([(TVc-TVc0)-(TVt-TVt0)]/(TVc-TVc0))×100; where 'TVc' is the mean tumor burden of a given control group, 'TVc0' is the mean initial tumor burden of a given control group, 'TVt' is the mean tumor burden of the treated group, and 'TVt0' is the mean initial tumor burden of the treated group. % TGI was defined as ([TVc-TVt]/TVc)×100.

A KLK2×CD3 compound of the present invention showed dose-dependent anti-tumor effect, i.e., at 1 mg/kg, showed marginal tumor growth inhibition and at 5 mg/kg showed anti-tumor effect. Cytokine assessment at 6 hours post first dosing showed above-background functional cytokine release of the active KLK2×CD3 compound, which is consistent with in vivo efficacy.

Example 6. Generation of HLA-G Cell Line

K562 chronic myelogenous leukemia cell line (ATCC®, CCL-243) lacking expression of all HLAs including the MHC class I proteins: HLA-A (Uniprot P01892), HLA-B (Uniprot P18464), HLA-C(Uniprot P30508), and HLA-E (Uniprot P13747) (therefore suitable for NK cell based killing), was transduced using a pCDH lentiviral vector to express HLA-G1-IRES (internal ribosome entry site)-β2M (LPP-CS-Z7412-10035-01-200, Genecopoeia) in lentiviral particles (Genecopoeia) and cultured in IMDM, 10% FBS. At passage one, selection with 10 μg/ml puromycin (Gibco, A1113803) to ensure stable HLA-G expression. Cells were split 1:10 when density reached ~3×10$^{6}$ cells/ml, approximately every 3-4 days.

Example 7: Generation of HLA-G Antibodies

Anti-HLA-G antibodies were generated using OmniRat® transgenic humanized rats. The OmniRat® contains a chimeric human/rat IgH locus (comprising 22 human $V_H$S, all human D and $J_H$ segments in natural configuration linked to the rat $C_H$ locus) together with fully human IgL loci (12 Vκs linked to Jκ-Cκ and 16 VWs linked to Jλ-Cλ). (see e.g., Osborn, et al. (2013) J Immunol 190(4): 1481-1490). Accordingly, the rats exhibit reduced expression of rat immunoglobulin, and in response to immunization, the introduced human heavy and light chain transgenes undergo class switching and somatic mutation to generate high affinity chimeric human/rat IgG monoclonal antibodies with fully human variable regions. The preparation and use of OmniRat®, and the genomic modifications carried by such rats, is described in WO14/093908.

OmniRat® rats were immunized using a construct comprising a subunit of either recombinant human HLA-G1 or recombinant human HLA-G5, a soluble isoform of HLA-G containing the α1, α2, and α3 domains but lacking the transmembrane region, fused to the β2m subunit and histone H2A, K562 cells expressing HLA-G1, or DNA encoding HLA-G1 extracellular domain with C42S mutation (Table 42). In some cases the histone H2A peptide was fused to the antigen for enhanced stability. Table 42 shows the sequences of the antigens.

TABLE 42

Sequences of antigens used to generate antibodies.

| Campaign | Protein AA ID | Sequence | SEQ ID NO: |
|---|---|---|---|
| HYB: 420, Hybridoma, OMT rats | MHGW8 (B2m-(3(G4S)-HLA-G1-G4S-Avi) | **MIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDMG**GGGSGGGGSGGGGSGSHSMRYFSAAVSRPGRGEPRFIAMGYVDDTQFVRFDSDSASPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPI*GGGGSGLNDIFEAQKIEWHE* | 371 |
| HYB: 420, Hybridoma, OMT rats | MHGW2 (H2A-2(G4S)-b2m-3(G4S)-HLA-G5-G4S-His-Avi) | RIIPRHLQLGGGGSGGGGS**IQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDM**GGGGSGGGGSGGGGSGSHSMRYFSAAVSRPGRGEPRFIAMGYVDDTQFVRFDSDSASPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWSKEGDGGIMSVRESRSLSEDL*GGGGSHHHHHHGSGLNDIFEAQKIEWHE* | 372 |
| HYB: 420, Hybridoma, OMT rats | $_{FL}$HLA-G1 | GSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD | 373 |
| HYB: 423, Hybridoma, OMT rats | pDR000057441 (H2A-3(G4S)-b2m-3G4S-HLA-G1-C42S) | DNA sequence, primary transcript: ATGGCTTGGGTGTGGACATTGTTGTTTCTGATGGCTGCTGCTCAATCTATTCAAGCTAGGATCATTCCTAGACATCTGCAACTCGGAGGCGGAGGCAGCGGAGGAGGAGGATCTGGAGGAGGAGGATCTATTCAGAGGACACCTAAGATTCAAGTGTACTCTAGACATCCTGCTGAGAACGGCAAGAGCAACTTTCTGAACTGC | 374 |

TABLE 42-continued

| Campaign | Protein AA ID | Sequence | SEQ ID NO: |
|---|---|---|---|
| | | TATGTGAGCGGCTTTCATCCTAGCGATATTGAAG TGGATCTGCTGAAAAACGGCGAACGTATTGAAAA AGTGGAACATAGCGATCTGAGCTTTAGCAAAGAT TGGAGCTTTTATCTGCTGTATTATACCGAATTTAC CCCTACCGAAAAAGATGAATATGCCTGCAGAGTG AACCATGTGACCCTGAGCCAGCCTAAGATTGTGA AATGGGATAGAGATATGGGAGGAGGAGGCTCTG GAGGAGGAGGATCTGGAGGCGGAGGCAGCGGCT CTCATAGCATGAGATATTTTAGCGCTGCAGTGAG CCGTCCTGGACGTGGAGAACCTAGGTTTATTGCT ATGGGCTATGTGGATGATACCCAGTTTGTGAGGT TTGATAGCGATAGCGCCTCTCCTAGGATGGAACC TAGAGCTCCCTGGGTGGAACAGGAAGGCCCAGA ATATTGGGAAGAAGAAACCAGGAACACCAAAGC ACATGCTCAGACCGATCGTATGAACCTGCAGACC CTGAGAGGCTATTATAACCAGAGCGAAGCATCTA GCCATACCCTGCAGTGGATGATTGGCTGCGATCT GGGCAGCGATGGCAGACTGCTGAGAGGCTATGA ACAGTATGCATATGATGGCAAAGATTATCTGGCA CTGAACGAAGATCTGAGGAGCTGGACCGCTGCTG ATACCGCTGCTCAGATTAGCAAGAGGAAGTGCGA AGCTGCTAACGTGGCTGAACAGAGACGCGCATAT CTGGAAGGCACCTGCGTGGAATGGCTGCATAGGT ATCTGGAAAACGGCAAAGAAATGCTGCAGAGAG CTGATCCTCCTAAAACCCATGTGACCCATCATCCT GTGTTTGATTATGAAGCTACCCTGAGGTGCTGGG CTCTGGGCTTCTATCCTGCTGAGATTATTCTGACC TGGCAGAGAGATGGAGAAGATCAGACTCAAGAT GTCGAGTTGGTCGAGACTAGACCTGCTGGAGATG GCACCTTTCAGAAGTGGGCAGCTGTTGTCGTGCC TAGCGGAGAAGAACAGAGATATACCTGCCATGTG CAGCATGAAGGCCTGCCTGAACCTCTGATGCTGA GGTGGAAACAGAGCAGCTTGCCTACTATTCCTAT TGGAGGAGGAGGATCTCACCATCATCATCATCAC TGA | |
| | | Mature Protein sequence:<br>QARIIPRHLQLGGGGSGGGGSGGGGS**IQRTPKIQVY SRHPAENGKSNFLNCYVSGFHPSDIEVDLLKNGE RIEKVEHSDLSFSKDWSFYLLYYTEFTPTEKDEY ACRVNHVTLSQPKIVKWDRDM**GGGGSGGGGSGG GGSGSHSMRYFSAAVSRPGRGEPRFIAMGYVDDTQ FVRFDSDSASPRMEPRAPWVEQEGPEYWEEETRNT KAHAQTDRMNLQTLRGYYNQSEASSHTLQWMIGC DLGSDGRLLRGYEQYAYDGKDYLALNEDLRSWTA ADTAAQISKRKCEAANVAEQRRAYLEGTCVEWLH RYLENGKEMLQRADPPKTHVTHEIPVFDYEATLRC WALGFYPAEIILTWQRDGEDQTQDVELVETRPAGD GTFQKWAAVVVPSGEEQRYTCHVQHEGLPEPLML RWKQSSLPTIPI*GGGGSHHHHHH* | 375 |
| HYB: 421, Hybridoma, OMT rats | | DNA sequence, primary transcript:<br>ATGGCTTGGGTGTGGACATTGTTGTTTCTGATGGC TGCTGCTCAATCTATTCAAGCTAGGATCATTCCTA GACATCTGCAACTCGGAGGCGGAGGCAGCGGAG GAGGAGGATCTGGAGGAGGAGGATCTATTCAGA GGACACCTAAGATTCAAGTGTACTCTAGACATCC TGCTGAGAACGGCAAGAGCAACTTTCTGAACTGC TATGTGAGCGGCTTTCATCCTAGCGATATTGAAG TGGATCTGCTGAAAAACGGCGAACGTATTGAAAA AGTGGAACATAGCGATCTGAGCTTTAGCAAAGAT TGGAGCTTTTATCTGCTGTATTATACCGAATTTAC CCCTACCGAAAAAGATGAATATGCCTGCAGAGTG AACCATGTGACCCTGAGCCAGCCTAAGATTGTGA AATGGGATAGAGATATGGGAGGAGGAGGCTCTG GAGGAGGAGGATCTGGAGGCGGAGGCAGCGGCT CTCATAGCATGAGATATTTTAGCGCTGCAGTGAG CCGTCCTGGACGTGGAGAACCTAGGTTTATTGCT ATGGGCTATGTGGATGATACCCAGTTTGTGAGGT TTGATAGCGATAGCGCCTCTCCTAGGATGGAACC TAGAGCTCCCTGGGTGGAACAGGAAGGCCCAGA ATATTGGGAAGAAGAAACCAGGAACACCAAAGC ACATGCTCAGACCGATCGTATGAACCTGCAGACC CTGAGAGGCTATTATAACCAGAGCGAAGCATCTA GCCATACCCTGCAGTGGATGATTGGCTGCGATCT GGGCAGCGATGGCAGACTGCTGAGAGGCTATGA | 376 |

TABLE 42-continued

Sequences of antigens used to generate antibodies.

| Campaign | Protein AA ID | Sequence | SEQ ID NO: |
|---|---|---|---|
| | | ACAGTATGCATATGATGGCAAAGATTATCTGGCA<br>CTGAACGAAGATCTGAGGAGCTGGACCGCTGCTG<br>ATACCGCTGCTCAGATTAGCAAGAGGAAGTGCGA<br>AGCTGCTAACGTGGCTGAACAGAGACGCGCATAT<br>CTGGAAGGCACCTGCGTGGAATGGCTGCATAGGT<br>ATCTGGAAAACGGCAAAGAAATGCTGCAGAGAG<br>CTGATCCTCCTAAAACCCATGTGACCCATCATCCT<br>GTGTTTGATTATGAAGCTACCCTGAGGTGCTGGG<br>CTCTGGGCTTCTATCCTGCTGAGATTATTCTGACC<br>TGGCAGAGAGATGGAGAAGATCAGACTCAAGAT<br>GTCGAGTTGGTCGAGACTAGACCTGCTGGAGATG<br>GCACCTTTCAGAAGTGGGCAGCTGTTGTCGTGCC<br>TAGCGGAGAAGAACAGAGATATACCTGCCATGTG<br>CAGCATGAAGGCCTGCCTGAACCTCTGATGCTGA<br>GGTGGAAACAGAGCAGCTTGCCTACTATTCCTAT<br>TGGAGGAGGAGGATCTCACCATCATCATCATCAC<br>TGA | |
| | | Mature Protein sequence:<br>RIIPRHLQLGGGGSGGGGSGGGGS**IQRTPKIQVYSR**<br>**HPAENGKSNFLNCYVSGFHPSDIEVDLLKNGERI**<br>**EKVEHSDLSFSKDWSFYLLYYTEFTPTEKDEYAC**<br>**RVNHVTLSQPKIVKWDRDM**GGGGSGGGGSGGGG<br>SGSHSMRYFSAAVSRPGRGEPRFIAMGYVDDTQFV<br>RFDSDSASPRMEPRAPWVEQEGPEYWEEETRNTKA<br>HAQTDRMNLQTLRGYYNQSEASSHTLQWMIGCDL<br>GSDGRLLRGYEQYAYDGKDYLALNEDLRSWTAAD<br>TAAQISKRKCEAANVAEQRRAYLEGTCVEWLHRY<br>LENGKEMLQRADPPKTHVTHHPVFDYEATLRCWA<br>LGFYPAEIILTWQRDGEDQTQDVELVETRPAGDGTF<br>QKWAAVVVPSGEEQRYTCHVQHEGLPEPLMLRWK<br>QSSLPTIPI*GGGGSHHHHHH* | 377 |
| HYB: 420,<br>Hybridoma,<br>OMT rats | pDR000066413<br>(Mafa-AG-<br>ECD-G4S-<br>6XHis-GS-Avi<br>T) | GSHSMRYFYTAVSRPGRGQPRFIAVGYVDDTQFVR<br>FDSDAESPRMEPRAPWVEQEGPEYWDRETQNMKT<br>ATQTYQANLRTLLRYYNQSEAGSHTFQKMYGCDL<br>GPDGRLLRGYEQFAYDGRDYIILNEDLRSWTAADM<br>AAQNTQRKWEAAGAAEQHRTYLEGECLEWLRRYL<br>ENGKETLQRADPPKTNVTHHPVSDYEATLRCWALG<br>FYPAEITLTWQRDGEEQTEDTELVETRPTGDGTFQK<br>WAAVVVPSGEEQRYTCHVQHEGLPKPLTLRWEPSS<br>QSTILIGGGGSHHHHHHGSGLNDIFEAQKIEWHE | 378 |
| | pDR000047703<br>(Cynomolgus<br>monkey beta 2-<br>microglobulin<br>(b2M)) | IQRTPKIQVYSRHPPENGKPNFLNCYVSGFHPSDIEV<br>DLLKNGEKMGKVEHSDLSFSKDWSFYLLYYTEFTP<br>NEKDEYACRVNHVTLSGPRTVKWDRDM | 379 |

H2A peptide is underlined.
The β2M subunit is highlighted bold.
His, Avi-, and Gly-Ser tags are italicized.

For HYB:420, OmniRats were immunized twice weekly for a total of 12 immunization boosts by following a Repetitive Immunizations Multiple Sites (RIMMS) protocol with recombinant human HLA-G1, human HLA-G5 and cynomolgus monkey Mafa-AG (homolog of HLA-G1) proteins. A final cell boost was performed using a hHLA-G1 K562 expressing cell line derived from K562 cells (ATCC® CCL-243™). Sera titers were determined via a solid phase ELISA with immunogen being coated on the plate. Draining lymph nodes were harvested for lymphocytes fusion with FO myeloma cells (ATCC® CRL-1646™) for hybridoma generation.

For HYB:423, OmniRats were immunized with human HLA-G pDNA (pDR000057441 (Table 3); C>S variant) via the tibialis muscle immediately followed by in vivo electroporation multiple times. Rats received a final boost of a combination of both human and cyno HLA-G over expressing cells. Draining lymph nodes were collected and fused with FO myeloma cells for hybridoma generation.

For HYB:421, OmniRats were immunized with human HLA-G pDNA into each tibialis muscle followed by in-vivo electroporation. Titers were assessed and ranged from 0-800 at Day 25. Rats were rested for several months and then further immunized with pDNA followed by a final boost with K562 cells exogenously overexpressing human HLA-G. Lower draining lymph nodes were used in downstream hybridoma generation.

To select antibody clones for downstream screening, hybridoma supernatants were screened for their abilities to bind cells expressing human HLA-G only and not to cells exogenously expressing HLA-A, HLA-B, and HLA-C, or wild type K562 cells, which do not express cell surface MHC class I antigens. Supernatants which displayed >20-fold higher binding to K562-HLA-G and 10-fold lower binding to K562-HLA-A/B/C (compared to isotype control) were selected for v-region sequencing and cloning. Monoclonal antibodies were generated in both silent format—lacking effector function (IgG4 PAA or IgG1 AAS, where “PAA” indicates P228S, L234A, L235A and “AAS” indicates mutation of L234A, L235A, D265S in EU numbering) and in active format—having normal effector function (IgG1). Antibodies were expressed in the supernatant from CHO cells and isolated by protein A affinity chromatography. Recombinant antibodies were then re-screened (as described above) for selectivity to HLA-G expressing cells as well as for their abilities to bind recombinant HLA-G (MHGW2). From these analyses, a panel of 48 unique v-regions was identified and 8 unique v-regions were selected for further analysis. Two of these 8 v-regions, derived from MHGB688 and MHGB694 were germline-optimized to result in MHGB738 and MHGB737, respectively.

Example 8. Structural Characterization of Anti HLA-G Antibodies

Variable domains of the select anti-HLA-G antibodies were expressed in a Fab format, a scFv format in the VH-linker-VL orientation or a scFv format in VL-linker-VH orientation.

Variable Domains VH, VL and CDRs

Table 43 shows the VH and VL amino acid sequences of selected anti-HLA-G antibodies. Table 44 shows the Kabat HCDR1, HCDR2 and HCDR3 of selected anti-HLA-G antibodies. Table 45 shows the Kabat LCDR1, LCDR2 and LCDR3 of the selected anti-HLA-G antibodies. Table 46 shows the Chothia HCDR1, HCDR2 and HCDR3 of selected anti-HLA-G antibodies. Table 47 shows the Chothia LCDR1, LCDR2 and LCDR3 of the anti-HLA-G. Table 48 shows the IMGT HCDR1, HCDR2 and HCDR3 of selected anti-HLA-G antibodies. Table 49 shows the IMGT LCDR1, LCDR2 and LCDR3 of the anti-HLA-G. Table 50 shows the AbM HCDR1, HCDR2 and HCDR3 of selected anti-HLA-G antibodies. Table 51 shows the AbM LCDR1, LCDR2 and LCDR3 of the anti-HLA-G.

TABLE 43

Variable region sequences of selected anti-HLA-G antibodies.

| Antibody | VH | SEQ ID No: | VL | SEQ ID No: |
|---|---|---|---|---|
| MHGB665<br>MHGB732 | QVQLQQSGPGLVKPSQTLSLT<br>CAISGDSVSSNSAAWNWIRQS<br>PSRGLEWLGRTYYRSKWYND<br>YAVSVKSRITINPDTSKNQISL<br>QLNSVTPEDTAVYYCAGDRR<br>YGIVGLPFAYWGQGTLVTVSS | 380 | DIVMTQSPDSLAVSLGERATI<br>NCKSSQSVLHSSNNKNYLTW<br>FQQKPGQPPKLLIYWASTRES<br>GVPDRFSGSGSGTDFTLTISSL<br>QAEDVAVYYCHQYYSTPPTF<br>GQGTKVEIK | 381 |
| MHGB668 | QVQLQQSGPGLVKPSQTLSLT<br>CAISGDSVSNNSAAWNWIRQS<br>PSRGLEWLGRTYYRSKWYND<br>YAVSVKSRITINPDTSKNQFSL<br>QLNSVTPEDTAVYYCARYGSG<br>TLLFDYWGQGTLVTVSS | 382 | DIVMTQSPDSLAVSLGERATI<br>NCKSSQSVLYSSKNKNYLAW<br>YQQKPGQPPKLLIYWASTRES<br>GVPDRFSGSGSGTDFTLTISSL<br>QAEDVAVYYCQQYYSTFPYT<br>FGQGTKLEIK | 383 |
| MHGB669 | QVQLQQSGPGLVRPSQTLSVT<br>CAISGDSVSSNSASWNWIRQSP<br>SRGLEWLGRTYYRSEWFNDY<br>AVSVKSRVTINPDTSKNQLSL<br>QLNSVIPEDTAVYYCAREARI<br>GVAGKGFDYWGQGTLVTVSS | 384 | DIVMTQSPDSLAVSLGERATI<br>NCKSSQSVLFRSNNKNYLAW<br>FQQKPGQPPKLLIYWASTRES<br>GVPDRFSGSGSGTDFTLTISSL<br>QAEDVAVYYCQQYYSTPRTF<br>GQGTKVEIK | 385 |
| MHGB672 | QVQLQQSGPGLVKPSQTLSLT<br>CAISGDSVSSNRAAWNWIRQT<br>PSRGLEWLGRTYYRSEWYND<br>YAVSVKSRITINPDTSKNQFSL<br>QLNSVTPEDTAVYYCARVRA<br>AVPFDYWGQGTLVTVSS | 386 | DIVMTQSPDSLAVSLGERATI<br>NCKSSQSVLFSSNNKNYLAW<br>YQQKPGQPPNLLIYWASTRES<br>GVPDRFSGSVSGTDFTLTISSL<br>QAEDVAIYYCQQYHSTPWTF<br>GQGTKVEIK | 387 |
| MHGB687 | QLQLQESGPGLVKPSETLSLM<br>CTVSGGSITSSSYYWGWIRQPP<br>GKGLEWIGNIYYSGTTYYNPS<br>LKSRVTISVDTSKNQFSLKLSS<br>VTAADTAVYYCAAGARDFDS<br>WGQGSLVTVSS | 388 | DIVMTQSPDSLAVSLGERATI<br>NCKSSQSVLYSSSNKSYLAW<br>YQQRPGQPPKLLIYWASTRES<br>GVPDRFSGSGSGTDFTLTISSL<br>QAEDVAVYYCQQYYSTPRM<br>YTFGQGTKLEIK | 389 |
| MHGB688 | EVQLLESGPGLVKPSQTLSLTC<br>VISGDSVSSNRAAWNWIRQSP<br>SRGLEWLGRTYYRSKWYNDY<br>AVSVKSRITINSDTSKNQISLQL<br>NSVTPEDTAVYYCARVRPGIP<br>FDYWGQGTPVTVSS | 390 | DIVMTQSPDSLAVSLGERATI<br>NCKSSQSVLFSSNKKNYLAW<br>YQQKPGQPPKLLIYWASTRES<br>GVPDRFSGSGSGTDFTLTISSL<br>QAEDVAVYYCQQYNSTPWT<br>FGQGTKVEIK | 391 |
| MHGB689 | QVQLQQSGPGLVKPSQTLSLT<br>CVISGDSVSSNRAAWNWIRQS<br>PSRGLEWLGRTYYRSKWYND<br>YAVSVKSRITINSDTSKNQISL<br>QLNSVTPEDTAVYYCARVRPG<br>IPFDYWGQGTTVTVSS | 392 | DIQMTQSPDSLAVSLGERATI<br>NCESSQSVLFSSNKKNYLAW<br>YQQKPGQPPKLLIYWASTRES<br>GVPDRFSGSGSGTDFTLTINR<br>LQAEDVAVYYCQQYNSTPW<br>TFGQGTKVEIK | 393 |

TABLE 43-continued

Variable region sequences of selected anti-HLA-G antibodies.

| Antibody | VH | SEQ ID No: | VL | SEQ ID No: |
|---|---|---|---|---|
| MHGB694 | EVQLLESGGGLVQPGGSLRLS CAASGFTFSSYAMHWVRQAP GKGLDWVSGISGSGFSTYYVD SVKGRFTISRDNSKHTLYLQM NSLRAEDTAVYYCAKDNLVA GTVFDYWGQGTLVTVSS | 394 | DIQMTQSPSTLSASVGDRVTI TCRASQSISSWLAWYQQKPG KAPKLLIYKASSLESGVPSRFS GSGSGTEFTLTISSLQPDDFAT YYCQQYNSYSLTFGGGTKVD IK | 395 |
| MHGB737 (GL-optimized B694) | EVQLLESGGGLVQPGGSLRLS CAASGFTFSSYAMEIWVRQAP GKGLEWVSGISGSGFSTYYVD SVKGRFTISRDNSKNTLYLQM NSLRAEDTAVYYCAKDNLVA GTVFDYWGQGTLVTVSS | 396 | DIQMTQSPSTLSASVGDRVTI TCRASQSISSWLAWYQQKPG KAPKLLIYKASSLESGVPSRFS GSGSGTEFTLTISSLQPDDFAT YYCQQYNSYSLTFGGGTKVD IK | 397 |
| MHGB738 (GL optimized B688 | QVQLQQSGPGLVKPSQTLSLT CAISGDSVSSNRAAWNWIRQS PSRGLEWLGRTYYRSKWYND YAVSVKSRITINPDTSKNQISL QLNSVTPEDTAVYYCARVRPG IPFDYWGQGTPVTVSS | 398 | DIVMTQSPDSLAVSLGERATI NCKSSQSVLFSSNNKNYLAW YQQKPGQPPKLLIYWASTRES GVPDRFSGSVSGTDFTLTISSL QAEDVAVYYCQQYHSTPWT FGQGTKVEIK | 399 |

TABLE 44

Kabat HCDR1, HCDR2 and HCDR3 of selected anti-HLA-G selected antibodies.

| | Kabat HCDR1 | | Kabat HCDR2 | | Kabat HCDR3 | |
|---|---|---|---|---|---|---|
| mAb name | Sequence | SEQ ID NO: | Sequence | SEQ ID NO: | Sequence | SEQ ID NO: |
| MHGB665 | SNSAAWN | 400 | RTYYRSKWYNDYAVSVKS | 401 | DRRYGIVGLPFAY | 402 |
| MHGB668 | NNSAAWN | 403 | RTYYRSKWYNDYAVSVKS | 401 | YGSGTLLFDY | 405 |
| MHGB669 | SNSASWN | 406 | RTYYRSEWFNDYAVSVKS | 407 | EARIGVAGKGFDY | 408 |
| MHGB672 | SNRAAWN | 409 | RTYYRSEWYNDYAVSVKS | 410 | VRAAVPFDY | 411 |
| MHGB687 | SSSYYWG | 412 | NIYYSGTTYYNPSLKS | 413 | GARDFDS | 414 |
| MHGB688 | SNRAAWN | 409 | RTYYRSKWYNDYAVSVKS | 401 | VRPGIPFDY | 415 |
| MHGB689 | SNRAAWN | 409 | RTYYRSKWYNDYAVSVKS | 401 | VRPGIPFDY | 415 |
| MHGB694 | SYAMH | 416 | GISGSGFSTYYVDSVKG | 417 | DNLVAGTVFDY | 418 |
| MHGB732 | SNSAAWN | 400 | RTYYRSKWYNDYAVSVKS | 401 | DRRYGIVGLPFAY | 402 |
| MHGB737 | SYAMH | 416 | GISGSGFSTYYVDSVKG | 417 | DNLVAGTVFDY | 418 |
| MHGB738 | SNRAAWN | 409 | RTYYRSKWYNDYAVSVKS | 401 | VRPGIPFDY | 415 |

TABLE 45

Kabat LCDR1, LCDR2 and LCDR3 of the selected anti-HLA-G antibodies.

| | Kabat LCDR1 | | Kabat LCDR2 | | Kabat LCDR3 | |
|---|---|---|---|---|---|---|
| mAb name | Sequence | SEQ ID NO: | Sequence | SEQ ID NO: | Sequence | SEQ ID NO: |
| MHGB665 | KSSQSVLHSSNNKNYLT | 419 | WASTRES | 420 | HQYYSTPPT | 421 |
| MHGB668 | KSSQSVLYSSKNKNYLA | 422 | WASTRES | 420 | QQYYSTFPYT | 423 |
| MHGB669 | KSSQSVLFRSNNKNYLA | 424 | WASTRES | 420 | QQYYSTPRT | 425 |

TABLE 45-continued

Kabat LCDR1, LCDR2 and LCDR3 of the selected anti-HLA-G antibodies.

| | Kabat LCDR1 | | Kabat LCDR2 | | Kabat LCDR3 | |
|---|---|---|---|---|---|---|
| mAb name | Sequence | SEQ ID NO: | Sequence | SEQ ID NO: | Sequence | SEQ ID NO: |
| MHGB672 | KSSQSVLFSSNNKNYLA | 426 | WASTRES | 420 | QQYHSTPWT | 427 |
| MHGB687 | KSSQSVLYSSSNKSYLA | 428 | WASTRES | 420 | QQYYSTPRMYT | 429 |
| MHGB688 | KSSQSVLFSSNKKNYLA | 430 | WASTRES | 420 | QQYNSTPWT | 431 |
| MHGB689 | ESSQSVLFSSNKKNYLA | 432 | WASTRES | 420 | QQYNSTPWT | 431 |
| MHGB694 | RASQSISSWLA | 433 | KASSLES | 434 | QQYNSYSLT | 435 |
| MHGB732 | KSSQSVLHSSNNKNYLT | 419 | WASTRES | 420 | HQYYSTPPT | 421 |
| MHGB737 | RASQSISSWLA | 433 | KASSLES | 434 | QQYNSYSLT | 435 |
| MHGB738 | KSSQSVLFSSNNKNYLA | 426 | WASTRES | 420 | QQYHSTPWT | 427 |

TABLE 46

Chothia HCDR1, HCDR2 and HCDR3 of selected anti-HLA-G antibodies.

| | Chothia HCDR1 | | Chothia HCDR2 | | Chothia HCDR3 | |
|---|---|---|---|---|---|---|
| mAb name | Sequence | SEQ ID NO: | Sequence | SEQ ID NO: | Sequence | SEQ ID NO: |
| MHGB665 | GDSVSSNSA | 436 | YYRSKWY | 437 | DRRYGIVGLPFA | 438 |
| MHGB668 | GDSVSNNSA | 439 | YYRSKWY | 437 | YGSGTLLFD | 440 |
| MHGB669 | GDSVSSNSA | 436 | YYRSEWF | 441 | EARIGVAGKGFD | 442 |
| MHGB672 | GDSVSSNRA | 443 | YYRSEWY | 444 | VRAAVPFD | 445 |
| MHGB687 | GGSITSSSY | 446 | YYSGT | 447 | GARDFD | 448 |
| MHGB688 | GDSVSSNRA | 443 | YYRSKWY | 437 | VRPGIPFD | 449 |
| MHGB689 | GDSVSSNRA | 443 | YYRSKWY | 437 | VRPGIPFD | 449 |
| MHGB694 | GFTFSSY | 450 | SGSGFS | 451 | DNLVAGTVFD | 452 |
| MHGB732 | GDSVSSNSA | 436 | YYRSKWY | 437 | DRRYGIVGLPFA | 438 |
| MHGB737 | GFTFSSY | 450 | SGSGFS | 451 | DNLVAGTVFD | 452 |
| MHGB738 | GDSVSSNRA | 443 | YYRSKWY | 437 | VRPGIPFD | 449 |

TABLE 47

Chothia LCDR1, LCDR2 and LCDR3 of the anti-HLA-G antibodies.

| | Chothia LCDR1 | | Chothia LCDR2 | | Chothia LCDR3 | |
|---|---|---|---|---|---|---|
| mAb name | Sequence | SEQ ID NO: | Sequence | SEQ ID NO: | Sequence | SEQ ID NO: |
| MHGB665 | SQSVLHSSNNKNY | 453 | WAS | 454 | YYSTPP | 455 |
| MHGB668 | SQSVLYSSSKNKNY | 456 | WAS | 454 | YYSTFPY | 457 |
| MHGB669 | SQSVLFRSNNKNY | 458 | WAS | 454 | YYSTPR | 459 |

TABLE 47-continued

Chothia LCDR1, LCDR2 and LCDR3 of the anti-HLA-G antibodies.

| | Chothia LCDR1 | | Chothia LCDR2 | | Chothia LCDR3 | |
|---|---|---|---|---|---|---|
| mAb name | Sequence | SEQ ID NO: | Sequence | SEQ ID NO: | Sequence | SEQ ID NO: |
| MHGB672 | SQSVLFSSNNKNY | 460 | WAS | 454 | YHSTPW | 461 |
| MHGB687 | SQSVLYSSSNKSY | 462 | WAS | 454 | YYSTPRMY | 728 |
| MHGB688 | SQSVLFSSNKKNY | 463 | WAS | 454 | YNSTPW | 464 |
| MHGB689 | SQSVLFSSNKKNY | 463 | WAS | 454 | YNSTPW | 464 |
| MHGB694 | SQSISSW | 465 | KAS | 466 | YNSYSL | 467 |
| MHGB732 | SQSVLHSSNNKNY | 453 | WAS | 454 | YYSTPP | 455 |
| MHGB737 | SQSISSW | 465 | KAS | 466 | YNSYSL | 467 |
| MHGB738 | SQSVLFSSNNKNY | 460 | WAS | 454 | YHSTPW | 461 |

TABLE 48

IMGT HCDR1, HCDR2 and HCDR3 of selected anti-HLA-G antibodies.

| | IMGT HCDR1 | | IMGT HCDR2 | | IMGT HCDR3 | |
|---|---|---|---|---|---|---|
| mAb name | Sequence | SEQ ID NO: | Sequence | SEQ ID NO: | Sequence | SEQ ID NO: |
| MHGB665 | GDSVSSNSAA | 468 | TYYRSKWYN | 469 | AGDRRYGIVGLPFAY | 470 |
| MHGB668 | GDSVSNNSAA | 471 | TYYRSKWYN | 469 | ARYGSGTLLFDY | 472 |
| MHGB669 | GDSVSSNSAS | 473 | TYYRSEWFN | 474 | AREARIGVAGKGFDY | 475 |
| MHGB672 | GDSVSSNRAA | 476 | TYYRSEWYN | 477 | ARVRAAVPFDY | 478 |
| MHGB687 | GGSITSSSYY | 479 | IYYSGTT | 480 | AAGARDFDS | 481 |
| MHGB688 | GDSVSSNRAA | 476 | TYYRSKWYN | 469 | ARVRPGIPFDY | 482 |
| MHGB689 | GDSVSSNRAA | 476 | TYYRSKWYN | 469 | ARVRPGIPFDY | 482 |
| MHGB694 | GFTFSSYA | 483 | ISGSGFST | 484 | AKDNLVAGTVFDY | 485 |
| MHGB732 | GDSVSSNSAA | 468 | TYYRSKWYN | 469 | AGDRRYGIVGLPFAY | 470 |
| MHGB737 | GFTFSSYA | 483 | ISGSGFST | 484 | AKDNLVAGTVFDY | 485 |
| MHGB738 | GDSVSSNRAA | 476 | TYYRSKWYN | 469 | ARVRPGIPFDY | 482 |

TABLE 49

IMGT LCDR1, LCDR2 and LCDR3 of the anti-HLA-G antibodies.

| | IMGT LCDR1 | | IMGT LCDR2 | | IMGT LCDR3 | |
|---|---|---|---|---|---|---|
| mAb name | Sequence | SEQ ID NO: | Sequence | SEQ ID NO: | Sequence | SEQ ID NO: |
| MHGB665 | QSVLHSSNNKNY | 486 | WAS | 454 | HQYYSTPPT | 487 |
| MHGB668 | QSVLYSSKNKNY | 488 | WAS | 454 | QQYYSTFPYT | 489 |
| MHGB669 | QSVLFRSNNKNY | 490 | WAS | 454 | QQYYSTPRT | 491 |
| MHGB672 | QSVLFSSNNKNY | 492 | WAS | 454 | QQYHSTPWT | 493 |

TABLE 49-continued

IMGT LCDR1, LCDR2 and LCDR3 of the anti-HLA-G antibodies.

| | IMGT LCDR1 | | IMGT LCDR2 | | IMGT LCDR3 | |
|---|---|---|---|---|---|---|
| mAb name | Sequence | SEQ ID NO: | Sequence | SEQ ID NO: | Sequence | SEQ ID NO: |
| MHGB687 | QSVLYSSSNKSY | 494 | WAS | 454 | QQYYSTPRMYT | 495 |
| MHGB688 | QSVLFSSNKKNY | 496 | WAS | 454 | QQYNSTPWT | 497 |
| MHGB689 | QSVLFSSNKKNY | 496 | WAS | 454 | QQYNSTPWT | 497 |
| MHGB694 | QSISSW | 498 | KAS | 466 | QQYNSYSLT | 499 |
| MHGB732 | QSVLHSSNNKNY | 486 | WAS | 454 | HQYYSTPPT | 487 |
| MHGB737 | QSISSW | 498 | KAS | 466 | QQYNSYSLT | 499 |
| MHGB738 | QSVLFSSNNKNY | 492 | WAS | 454 | QQYHSTPWT | 493 |

TABLE 50

AbM HCDR1, HCDR2 and HCDR3 of selected anti-HLA-G antibodies.

| | AbM HCDR1 | | AbM HCDR2 | | AbM HCDR3 | |
|---|---|---|---|---|---|---|
| mAb name | Sequence | SEQ ID NO: | Sequence | SEQ ID NO: | Sequence | SEQ ID NO: |
| MHGB665 | GDSVSSNSAAWN | 500 | RTYYRSKWYND | 501 | DRRYGIVGLPFAY | 502 |
| MHGB668 | GDSVSNNSAAWN | 503 | RTYYRSKWYND | 501 | YGSGTLLFDY | 504 |
| MHGB669 | GDSVSSNSASWN | 505 | RTYYRSEWFND | 506 | EARIGVAGKGFDY | 507 |
| MHGB672 | GDSVSSNRAAWN | 508 | RTYYRSEWYND | 509 | VRAAVPFDY | 510 |
| MHGB687 | GGSITSSSYYWG | 511 | NIYYSGTTY | 512 | GARDFDS | 513 |
| MHGB688 | GDSVSSNRAAWN | 508 | RTYYRSKWYND | 501 | VRPGIPFDY | 514 |
| MHGB689 | GDSVSSNRAAWN | 508 | RTYYRSKWYND | 501 | VRPGIPFDY | 514 |
| MHGB694 | GFTFSSYAMH | 515 | GISGSGFSTY | 516 | DNLVAGTVFDY | 517 |
| MHGB732 | GDSVSSNSAAWN | 500 | RTYYRSKWYND | 501 | DRRYGIVGLPFAY | 502 |
| MHGB737 | GFTFSSYAMH | 515 | GISGSGFSTY | 516 | DNLVAGTVFDY | 517 |
| MHGB738 | GDSVSSNRAAWN | 508 | RTYYRSKWYND | 501 | VRPGIPFDY | 514 |

TABLE 51

AbM LCDR1, LCDR2 and LCDR3 of the anti-HLA-G antibodies.

| | AbM LCDR1 | | AbM LCDR2 | | AbM LCDR3 | |
|---|---|---|---|---|---|---|
| mAb name | Sequence | SEQ ID NO: | Sequence | SEQ ID NO: | Sequence | SEQ ID NO: |
| MHGB665 | KSSQSVLHSSNNKNYLT | 518 | WASTRES | 519 | HQYYSTPPT | 520 |
| MHGB668 | KSSQSVLYSSKNKNYLA | 521 | WASTRES | 519 | QQYYSTFPYT | 522 |
| MHGB669 | KSSQSVLFRSNNKNYLA | 523 | WASTRES | 519 | QQYYSTPRT | 524 |
| MHGB672 | KSSQSVLFSSNNKNYLA | 525 | WASTRES | 519 | QQYHSTPWT | 526 |
| MHGB687 | KSSQSVLYSSSNKSYLA | 527 | WASTRES | 519 | QQYYSTPRMYT | 528 |

TABLE 51-continued

AbM LCDR1, LCDR2 and LCDR3 of the anti-HLA-G antibodies.

| mAb name | AbM LCDR1 Sequence | SEQ ID NO: | AbM LCDR2 Sequence | SEQ ID NO: | AbM LCDR3 Sequence | SEQ ID NO: |
|---|---|---|---|---|---|---|
| MHGB688 | KSSQSVLFSSNKKNYLA | 529 | WASTRES | 519 | QQYNSTPWT | 530 |
| MHGB689 | ESSQSVLFSSNKKNYLA | 531 | WASTRES | 519 | QQYNSTPWT | 530 |
| MHGB694 | RASQSISSWLA | 532 | KASSLES | 533 | QQYNSYSLT | 534 |
| MHGB732 | KSSQSVLHSSNNKNYLT | 518 | WASTRES | 519 | HQYYSTPPT | 520 |
| MHGB737 | RASQSISSWLA | 532 | KASSLES | 533 | QQYNSYSLT | 534 |
| MHGB738 | KSSQSVLFSSNNKNYLA | 525 | WASTRES | 519 | QQYHSTPWT | 526 |

Germline Optimization

The v-region sequences of the antibodies were analyzed for risks of potential post-translational modifications, for germline fitness, and for their abilities to format as scFv. Two antibodies, MHGB694 and MHGB688 were germline-optimized. The v-region of MHGB694 contained two germline mutations (E46D and N77H), and this v-region was thus was optimized by back-mutation of these residues to the germline sequence at those sites to generate MHGB737 variable region by mutation of D46E and H77N in the VH domain. The v-region of MHGB688 was similarly optimized by mutation of E1Q, L5Q, E6Q, and S71P in the VH domain and by mutation of K30E, G66V in the VL. We found that MHGB688 also contained an "NS" motif at position 92-93 (Kabat) which presents a risk for deamidation. Since the VL of MHGB672 had identical LC-CDRs except that it contained "HS" at positions 92-93, we mutated N92H. This combination of changes resulted in MHGB738.

Fab-Fc and scFvs

The HLA-G specific VH/VL domains were engineered to be expressed either in an antibody format, or as an scFv, or as an arm of a bi-specific (as either Fab-Fc or scFv-Fc). The antibody format and the Fab-Fc bi-specific arm format included a heavy chain as VH-CH1-hinge-CH2-CH3 and the light chain as VL-CL and expressed as IgG2 or IgG4. The scFv-Fc format included either the VH-Linker-VL-Fc or VL-linker-VH-Fc orientations. The linker that is used in the scFv was the linker of SEQ ID NO: 31 described above. The scFv-Fc and Fab-Fc were used to generate bispecific antibodies as described in Example 14.

Table 52 shows the HC amino acid sequences of selected anti-HLA-G antibodies. Table 53 shows the LC amino acid sequences of selected anti-HLA-G antibodies. Table 54 summarizes the HC and LC DNA SEQ ID NOs of selected anti-HLA-G antibodies. Table 55 shows the amino acid sequences of selected scFvs in VH-linker-VL or VL-linker-VH orientation. Table 56 shows the amino acid sequences of selected scFv-Fc. Table 57 shows the scFv and scFv-Fc DNA SEQ ID NOs of selected anti-HLA-G antibodies in the scFv-Fc format.

TABLE 52

Amino acid sequence of the HC (VH-CH1-hinge-CH2-CH3) of selected anti-HLA-G antibodies in a mAb format.

| HLA-G HEAVY CHAIN | SEQ ID NO: | AMINO ACID SEQUENCE |
|---|---|---|
| MHGB665 HC | 535 | QVQLQQSGPGLVKPSQTLSLTCAISGDSVSSNSAAWNWIRQSPSRGLE WLGRTYYRSKWYNDYAVSVKSRITINPDTSKNQISLQLNSVTPEDTAVY YCAGDRRYGIVGLPFAYWGQGTLVTVSSASTKGPSVFPLAPSSKSTSG GTAALGCLVKDYFPEPVTVSWNSGALTSGVHTFPAVLQSSGLYSLSSVV TVPSSSLGTQTYICNVNHKPSNTKVDKKVEPKSCDKTHTCPPCPAPELL GGPSVFLFPPKPKDTLMISRTPEVTCVVVDVSHEDPEVKFNWYVDGVEV HNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWE SNGQPENNYKTTPPVLDSDGSFFLYSKLTVDKSRWQQGNVFSCSVMH EALHNHYTQKSLSLSPGK |
| MHGB668 HC | 536 | QVQLQQSGPGLVKPSQTLSLTCAISGDSVSNNSAAWNWIRQSPSRGLE WLGRTYYRSKWYNDYAVSVKSRITINPDTSKNQFSLQLNSVTPEDTAVY YCARYGSGTLLFDYWGQGTLVTVSSASTKGPSVFPLAPSSKSTSGGTA ALGCLVKDYFPEPVTVSWNSGALTSGVHTFPAVLQSSGLYSLSSVVTVP SSSLGTQTYICNVNHKPSNTKVDKKVEPKSCDKTHTCPPCPAPELLGGP SVFLFPPKPKDTLMISRTPEVTCVVVDVSHEDPEVKFNWYVDGVEVHNA KTKPREEQYNSTYRVVSVLTVLHQDWLNGKEYKCKVSNKALPAPIEKTIS KAKGQPREPQVYTLPPSREEMTKNQVSLTCLVKGFYPSDIAVEWESNG QPENNYKTTPPVLDSDGSFFLYSKLTVDKSRWQQGNVFSCSVMHEALH NHYTQKSLSLSPGK |
| MHGB669 HC | 537 | QVQLQQSGPGLVRPSQTLSVTCAISGDSVSSNSASWNWIRQSPSRGLE WLGRTYYRSEWFNDYAVSVKSRVTINPDTSKNQLSLQLNSVIPEDTAVY |

TABLE 52-continued

Amino acid sequence of the HC (VH-CH1-hinge-CH2-CH3) of selected anti-HLA-G antibodies in a mAb format.

| HLA-G HEAVY CHAIN | SEQ ID NO: | AMINO ACID SEQUENCE |
|---|---|---|
| | | YCAREARIGVAGKGFDYWGQGTLVTVSSASTKGPSVFPLAPSSKSTSG GTAALGCLVKDYFPEPVTVSWNSGALTSGVHTFPAVLQSSGLYSLSSVV TVPSSSLGTQTYICNVNHKPSNTKVDKKVEPKSCDKTHTCPPCPAPELL GGPSVFLFPPKPKDTLMISRTPEVTCVVVDVSHEDPEVKFNWYVDGVEV HNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWE SNGQPENNYKTTPPVLDSDGSFFLYSKLTVDKSRWQQGNVFSCSVMH EALHNHYTQKSLSLSPGK |
| MHGB672 HC | 538 | QVQLQQSGPGLVKPSQTLSLTCAISGDSVSSNRAAWNWIRQTPSRGLE WLGRTYYRSEVVYNDYAVSVKSRITINPDTSKNQFSLQLNSVTPEDTAVY YCARVRAAVPFDYWGQGTLVTVSSASTKGPSVFPLAPSSKSTSGGTAA LGCLVKDYFPEPVTVSWNSGALTSGVHTFPAVLQSSGLYSLSSVVTVPS SSLGTQTYICNVNHKPSNTKVDKKVEPKSCDKTHTCPPCPAPELLGGPS VFLFPPKPKDTLMISRTPEVTCVVVDVSHEDPEVKFNWYVDGVEVHNAK TKPREEQYNSTYRVVSVLTVLHQDWLNGKEYKCKVSNKALPAPIEKTISK AKGQPREPQVYTLPPSREEMTKNQVSLTCLVKGFYPSDIAVEWESNGQ PENNYKTTPPVLDSDGSFFLYSKLTVDKSRWQQGNVFSCSVMHEALHN HYTQKSLSLSPGK |
| MHGB687 HC | 539 | QLQLQESGPGLVKPSETLSLMCTVSGGSITSSSYYWGWIRQPPGKGLE WIGNIYYSGTTYYNPSLKSRVTISVDTSKNQFSLKLSSVTAADTAVYYCA AGARDFDSWGQGSLVTVSSASTKGPSVFPLAPSSKSTSGGTAALGCLV KDYFPEPVTVSWNSGALTSGVHTFPAVLQSSGLYSLSSVVTVPSSSLGT QTYICNVNHKPSNTKVDKKVEPKSCDKTHTCPPCPAPELLGGPSVFLFP PKPKDTLMISRTPEVTCVVVDVSHEDPEVKFNWYVDGVEVHNAKTKPR EEQYNSTYRVVSVLTVLHQDWLNGKEYKCKVSNKALPAPIEKTISKAKG QPREPQVYTLPPSREEMTKNQVSLTCLVKGFYPSDIAVEWESNGQPEN NYKTTPPVLDSDGSFFLYSKLTVDKSRWQQGNVFSCSVMHEALHNHYT QKSLSLSPGK |
| MHGB688 HC | 540 | EVQLLESGPGLVKPSQTLSLTCVISGDSVSSNRAAWNWIRQSPSRGLE WLGRTYYRSKWYNDYAVSVKSRITINSDTSKNQISLQLNSVTPEDTAVY YCARVRPGIPFDYWGQGTPVTVSSASTKGPSVFPLAPSSKSTSGGTAAL GCLVKDYFPEPVTVSWNSGALTSGVHTFPAVLQSSGLYSLSSVVTVPSS SLGTQTYICNVNHKPSNTKVDKKVEPKSCDKTHTCPPCPAPELLGGPSV FLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISK AKGQPREPQVYTLPPSREEMTKNQVSLTCLVKGFYPSDIAVEWESNGQ PENNYKTTPPVLDSDGSFFLYSKLTVDKSRWQQGNVFSCSVMHEALHN HYTQKSLSLSPGK |
| MHGB689 HC | 541 | QVQLQQSGPGLVKPSQTLSLTCVISGDSVSSNRAAWNWIRQSPSRGLE WLGRTYYRSKWYNDYAVSVKSRITINSDTSKNQISLQLNSVTPEDTAVY YCARVRPGIPFDYWGQGTTVTVSSASTKGPSVFPLAPSSKSTSGGTAAL GCLVKDYFPEPVTVSWNSGALTSGVHTFPAVLQSSGLYSLSSVVTVPSS SLGTQTYICNVNHKPSNTKVDKKVEPKSCDKTHTCPPCPAPELLGGPSV FLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISK AKGQPREPQVYTLPPSREEMTKNQVSLTCLVKGFYPSDIAVEWESNGQ PENNYKTTPPVLDSDGSFFLYSKLTVDKSRWQQGNVFSCSVMHEALHN HYTQKSLSLSPGK |
| MHGB694 HC | 542 | EVQLLESGGGLVQPGGSLRLSCAASGFTFSSYAMHWVRQAPGKGLDW VSGISGSGFSTYYVDSVKGRFTISRDNSKHTLYLQMNSLRAEDTAVYYC AKDNLVAGTVFDYWGQGTLVTVSSASTKGPSVFPLAPSSKSTSGGTAA LGCLVKDYFPEPVTVSWNSGALTSGVHTFPAVLQSSGLYSLSSVVTVPS SSLGTQTYICNVNHKPSNTKVDKKVEPKSCDKTHTCPPCPAPELLGGPS VFLFPPKPKDTLMISRTPEVTCVVVDVSHEDPEVKFNWYVDGVEVHNAK TKPREEQYNSTYRVVSVLTVLHQDWLNGKEYKCKVSNKALPAPIEKTISK AKGQPREPQVYTLPPSREEMTKNQVSLTCLVKGFYPSDIAVEWESNGQ PENNYKTTPPVLDSDGSFFLYSKLTVDKSRWQQGNVFSCSVMHEALHN HYTQKSLSLSPGK |
| MHGB732 HC | 543 | QVQLQQSGPGLVKPSQTLSLTCAISGDSVSSNSAAWNWIRQSPSRGLE WLGRTYYRSKWYNDYAVSVKSRITINPDTSKNQISLQLNSVTPEDTAVY YCAGDRRYGIVGLPFAYWGQGTLVTVSSASTKGPSVFPLAPSSKSTSG GTAALGCLVKDYFPEPVTVSWNSGALTSGVHTFPAVLQSSGLYSLSSVV TVPSSSLGTQTYICNVNHKPSNTKVDKKVEPKSCDKTHTCPPCPAPELL GGPSVFLFPPKPKDTLMISRTPEVTCVVVDVSHEDPEVKFNWYVDGVEV |

TABLE 52-continued

Amino acid sequence of the HC (VH-CH1-hinge-CH2-CH3) of selected anti-HLA-G antibodies in a mAb format.

| HLA-G HEAVY CHAIN | SEQ ID NO: | AMINO ACID SEQUENCE |
|---|---|---|
| | | HNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWE SNGQPENNYKTTPPVLDSDGSFFLYSKLTVDKSRWQQGNVFSCSVMH EALHNHYTQKSLSLSPG |
| MHGB737 HC | 544 | EVQLLESGGGLVQPGGSLRLSCAASGFTFSSYAMHWVRQAPGKGLEW VSGISGSGFSTYYVDSVKGRFTISRDNSKNTLYLQMNSLRAEDTAVYYC AKDNLVAGTVFDYWGQGTLVTVSSASTKGPSVFPLAPSSKSTSGGTAA LGCLVKDYFPEPVTVSWNSGALTSGVHTFPAVLQSSGLYSLSSVVTVPS SSLGTQTYICNVNHKPSNTKVDKKVEPKSCDKTHTCPPCPAPELLGGPS VFLFPPKPKDTLMISRTPEVTCVVVDVSHEDPEVKFNWYVDGVEVHNAK TKPREEQYNSTYRVVSVLTVLHQDWLNGKEYKCKVSNKALPAPIEKTISK AKGQPREPQVYTLPPSREEMTKNQVSLTCLVKGFYPSDIAVEWESNGQ PENNYKTTPPVLDSDGSFFLYSKLTVDKSRWQQGNVFSCSVMHEALHN HYTQKSLSLSPG |
| MHGB738 HC | 545 | QVQLQQSGPGLVKPSQTLSLTCAISGDSVSSNRAAWNWIRQSPSRGLE WLGRTYYRSKWYNDYAVSVKSRITINPDTSKNQISLQLNSVTPEDTAVY YCARVRPGIPFDYWGQGTPVTVSSASTKGPSVFPLAPSSKSTSGGTAAL GCLVKDYFPEPVTVSWNSGALTSGVHTFPAVLQSSGLYSLSSVVTVPSS SLGTQTYICNVNHKPSNTKVDKKVEPKSCDKTHTCPPCPAPELLGGPSV FLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISK AKGQPREPQVYTLPPSREEMTKNQVSLTCLVKGFYPSDIAVEWESNGQ PENNYKTTPPVLDSDGSFFLYSKLTVDKSRWQQGNVFSCSVMHEALHN HYTQKSLSLSPG |

TABLE 53

Amino acid sequences of the LC (VL-CL) of selected anti-HLA-G antibodies in a mAb (Fab-Fc) format.

| HLA-G LIGHT CHAIN | SEQ ID NO: | AMINO ACID SEQUENCE |
|---|---|---|
| MHGB665 | 546 | DIVMTQSPDSLAVSLGERATINCKSSQSVLHSSNNKNYLTWFQQK PGQPPKLLIYWASTRESGVPDRFSGSGSGTDFTLTISSLQAEDVAV YYCHQYYSTPPTFGQGTKVEIKRTVAAPSVFIFPPSDEQLKSGTAS VVCLLNNFYPREAKVQWKVDNALQSGNSQESVTEQDSKDSTYSL SSTLTLSKADYEKHKVYACEVTHQGLSSPVTKSFNRGEC |
| MHGB668 | 547 | DIVMTQSPDSLAVSLGERATINCKSSQSVLYSSKNKNYLAVVYQQK PGQPPKLLIYWASTRESGVPDRFSGSGSGTDFTLTISSLQAEDVAV YYCQQYYSTFPYTFGQGTKLEIKRTVAAPSVFIFPPSDEQLKSGTA SVVCLLNNFYPREAKVQWKVDNALQSGNSQESVTEQDSKDSTYS LSSTLTLSKADYEKHKVYACEVTHQGLSSPVTKSFNRGEC |
| MHGB669 | 548 | DIVMTQSPDSLAVSLGERATINCKSSQSVLFRSNNKNYLAWFQQK PGQPPKLLIYWASTRESGVPDRFSGSGSGTDFTLTISSLQAEDVAV YYCQQYYSTPRTFGQGTKVEIKRTVAAPSVFIFPPSDEQLKSGTAS VVCLLNNFYPREAKVQWKVDNALQSGNSQESVTEQDSKDSTYSL SSTLTLSKADYEKHKVYACEVTHQGLSSPVTKSFNRGEC |
| MHGB672 | 549 | DIVMTQSPDSLAVSLGERATINCKSSQSVLFSSNNKNYLAVVYQQK PGQPPNLLIYWASTRESGVPDRFSGSVSGTDFTLTISSLQAEDVAI YYCQQYHSTPVVTFGQGTKVEIKRTVAAPSVFIFPPSDEQLKSGTA SVVCLLNNFYPREAKVQWKVDNALQSGNSQESVTEQDSKDSTYS LSSTLTLSKADYEKHKVYACEVTHQGLSSPVTKSFNRGEC |
| MHGB687 | 550 | DIVMTQSPDSLAVSLGERATINCKSSQSVLYSSSNKSYLAVVYQQR PGQPPKLLIYWASTRESGVPDRFSGSGSGTDFTLTISSLQAEDVAV YYCQQYYSTPRMYTFGQGTKLEIKRTVAAPSVFIFPPSDEQLKSGT ASVVCLLNNFYPREAKVQWKVDNALQSGNSQESVTEQDSKDSTY SLSSTLTLSKADYEKHKVYACEVTHQGLSSPVTKSFNRGEC |
| MHGB688 | 551 | DIVMTQSPDSLAVSLGERATINCKSSQSVLFSSNKKNYLAVVYQQK PGQPPKLLIYWASTRESGVPDRFSGSGSGTDFTLTISSLQAEDVAV YYCQQYNSTPVVTFGQGTKVEIKRTVAAPSVFIFPPSDEQLKSGTA SVVCLLNNFYPREAKVQWKVDNALQSGNSQESVTEQDSKDSTYS LSSTLTLSKADYEKHKVYACEVTHQGLSSPVTKSFNRGEC |

TABLE 53-continued

Amino acid sequences of the LC (VL-CL) of selected anti-HLA-G antibodies in a mAb (Fab-Fc) format.

| HLA-G LIGHT CHAIN | SEQ ID NO: | AMINO ACID SEQUENCE |
|---|---|---|
| MHGB689 | 552 | DIQMTQSPDSLAVSLGERATINCESSQSVLFSSNKKNYLAVVYQQK PGQPPKLLIYWASTRESGVPDRFSGSGSGTDFTLTINRLQAEDVA VYYCQQYNSTPVVTFGQGTKVEIKRTVAAPSVFIFPPSDEQLKSGT ASVVCLLNNFYPREAKVQWKVDNALQSGNSQESVTEQDSKDSTY SLSSTLTLSKADYEKHKVYACEVTHQGLSSPVTKSFNRGEC |
| MHGB694 | 553 | DIQMTQSPSTLSASVGDRVTITCRASQSISSWLAVVYQQKPGKAPK LLIYKASSLESGVPSRFSGSGSGTEFTLTISSLQPDDFATYYCQQY NSYSLTFGGGTKVDIKRTVAAPSVFIFPPSDEQLKSGTASVVCLLN NFYPREAKVQWKVDNALQSGNSQESVTEQDSKDSTYSLSSTLTLS KADYEKHKVYACEVTHQGLSSPVTKSFNRGEC |
| MHGB732 | 554 | DIVMTQSPDSLAVSLGERATINCKSSQSVLHSSNNKNYLTWFQQK PGQPPKLLIYWASTRESGVPDRFSGSGSGTDFTLTISSLQAEDVAV YYCHQYYSTPPTFGQGTKVEIKRTVAAPSVFIFPPSDEQLKSGTAS VVCLLNNFYPREAKVQWKVDNALQSGNSQESVTEQDSKDSTYSL SSTLTLSKADYEKHKVYACEVTHQGLSSPVTKSFNRGEC |
| MHGB737 | 555 | DIQMTQSPSTLSASVGDRVTITCRASQSISSWLAVVYQQKPGKAPK LLIYKASSLESGVPSRFSGSGSGTEFTLTISSLQPDDFATYYCQQY NSYSLTFGGGTKVDIKRTVAAPSVFIFPPSDEQLKSGTASVVCLLN NFYPREAKVQWKVDNALQSGNSQESVTEQDSKDSTYSLSSTLTLS KADYEKHKVYACEVTHQGLSSPVTKSFNRGEC |
| MHGB738 | 556 | DIVMTQSPDSLAVSLGERATINCKSSQSVLFSSNNKNYLAVVYQQK PGQPPKLLIYWASTRESGVPDRFSGSVSGTDFTLTISSLQAEDVAV YYCQQYHSTPVVTFGQGTKVEIKRTVAAPSVFIFPPSDEQLKSGTA SVVCLLNNFYPREAKVQWKVDNALQSGNSQESVTEQDSKDSTYS LSSTLTLSKADYEKHKVYACEVTHQGLSSPVTKSFNRGEC |

TABLE 54

SEQ ID Nos of the cDNA sequences of HC and LC of selected HLA-G antibodies

| Antibody | HC cDNA SEQ ID NO: | LC cDNA SEQ ID NO: |
|---|---|---|
| MHGB665 | 557 | 558 |
| MHGB668 | 559 | 560 |
| MHGB669 | 561 | 562 |
| MHGB672 | 563 | 564 |
| MHGB687 | 565 | 566 |
| MHGB688 | 567 | 568 |
| MHGB689 | 569 | 570 |
| MHGB694 | 571 | 572 |
| MHGB732 | 573 | 574 |
| MHGB737 | 575 | 576 |
| MHGB738 | 577 | 578 |

SEQ ID NO: 557
CAGGTGCAGCTGCAGCAGAGCGGCCCTGGACTGGTGAAGCCCAGCCAGACCCTGAG
CCTGACCTGCGCTATCAGCGGCGATAGCGTGAGCTCCAACAGCGCCGCCTGGAACTGGATCA
GGCAGAGCCCTAGCAGGGGCCTGGAATGGCTGGGCAGGACCTACTACAGGAGCAAGTGGTA
CAACGACTACGCCGTGTCCGTGAAGAGCAGGATCACCATCAACCCCGACACCAGCAAGAAC
CAGATCAGCCTGCAGCTGAACAGCGTGACCCCCGAGGACACCGCCGTGTACTACTGCGCCG
GCGACAGAAGGTACGGCATCGTGGGCCTGCCTTTCGCCTACTGGGGCCAGGGAACCCTGGT
GACCGTGAGCAGCGCCTCCACCAAGGGCCCATCGGTCTTCCCCCTGGCACCCTCCTCCAAGA
GCACCTCTGGGGGCACAGCGGCCCTGGGCTGCCTGGTCAAGGACTACTTCCCCGAACCGGTG
ACGGTGTCGTGGAACTCAGGCGCCCTGACCAGCGGCGTGCACACCTTCCCGGCTGTCCTACA
GTCCTCAGGACTCTACTCCCTCAGCAGCGTGGTGACCGTGCCCTCCAGCAGCTTGGGCACCC

TABLE 54-continued

| SEQ ID Nos of the cDNA sequences of HC and LC of selected HLA-G antibodies |
|---|
| AGACCTACATCTGCAACGTGAATCACAAGCCCAGCAACACCAAGGTGGACAAGAAAGTTGA GCCCAAATCTTGTGACAAAACTCACACATGCCCACCGTGCCCAGCACCTGAACTCCTGGGGG GACCGTCAGTCTTCCTCTTCCCCCCAAAACCCAAGGACACCCTCATGATCTCCCGGACCCCT GAGGTCACATGCGTGGTGGTGGACGTGAGCCACGAAGACCCTGAGGTCAAGTTCAACTGGT ACGTGGACGGCGTGGAGGTGCATAATGCCAAGACAAAGCCGCGGGAGGAGCAGTACAACA GCACGTACCGTGTGGTCAGCGTCCTCACCGTCCTGCACCAGGACTGGCTGAATGGCAAGGAG TACAAGTGCAAGGTCTCCAACAAAGCCCTCCCAGCCCCCATCGAGAAAACCATCTCCAAAG CCAAAGGGCAGCCCCGAGAACCACAGGTGTACACCCTGCCCCCATCCCGGGAGGAGATGAC CAAGAACCAGGTCAGCCTGACCTGCCTGGTCAAAGGCTTCTATCCCAGCGACATCGCCGTGG AGTGGGAGAGCAATGGGCAGCCGGAGAACAACTACAAGACCACGCCTCCCGTGCTGGACTC CGACGGCTCCTTCTTCCTCTACAGCAAGCTCACCGTGGACAAGAGCAGGTGGCAGCAGGGG AACGTCTTCTCATGCTCCGTGATGCATGAGGCTCTGCACAACCACTACACGCAGAAGAGCCT CTCCCTGTCTCCGGGTAAA |
| SEQ ID NO: 558<br>GACATCGTGATGACCCAGAGCCCCGATAGCCTGGCTGTGAGCCTGGGCGAGAGAGC CACCATCAACTGCAAGAGCAGCCAGAGCGTGCTGCACAGCAGCAACAACAAGAACTACCTG ACCTGGTTCCAGCAGAAGCCCGGCCAGCCTCCCAAGCTGCTGATCTACTGGGCTAGCACCAG AGAGTCCGGCGTGCCTGACAGGTTCAGCGGAAGCGGCAGCGGCACCGACTTCACCCTGACC ATCAGCAGCCTGCAGGCCGAGGACGTGGCCGTGTACTACTGCCACCAGTACTACAGCACCCC CCCTACCTTTGGCCAGGGCACCAAGGTGGAGATCAAGCGTACGGTGGCTGCACCATCTGTCT TCATCTTCCCGCCATCTGATGAGCAGTTGAAATCTGGAACTGCCTCTGTTGTGTGCCTGCTGA ATAACTTCTATCCCAGAGAGGCCAAAGTACAGTGGAAGGTGGATAACGCCCTCCAATCGGG TAACTCCCAGGAGAGTGTCACAGAGCAGGACAGCAAGGACAGCACCTACAGCCTCAGCAGC ACCCTGACGCTGAGCAAAGCAGACTACGAGAAACACAAAGTCTACGCCTGCGAAGTCACCC ATCAGGGCCTGAGCTCGCCCGTCACAAAGAGCTTCAACAGGGGAGAGTGT |
| SEQ ID NO: 559<br>CAGGTGCAGCTGCAGCAGAGCGGACCCGGCCTGGTGAAACCCAGCCAGACCCTGAG CCTGACCTGCGCCATCAGCGGCGACAGCGTGAGCAACAACAGCGCCGCCTGGAACTGGATC AGGCAGAGCCCCAGCAGAGGCCTGGAATGGCTGGGCAGGACCTACTACAGGAGCAAGTGGT ACAACGACTACGCCGTGAGCGTGAAGAGCAGGATCACCATCAACCCCGACACCTCCAAGAA CCAGTTCAGCCTGCAGCTGAACAGCGTGACCCCCGAGGACACCGCCGTGTACTACTGCGCCA GGTATGGCAGCGGCACCCTGCTGTTCGACTACTGGGGCCAGGGCACCCTGGTGACAGTGAG CAGCGCCTCCACCAAGGGCCCATCGGTCTTCCCCCTGGCACCCTCCTCCAAGAGCACCTCTG GGGGCACAGCGGCCCTGGGCTGCCTGGTCAAGGACTACTTCCCCGAACCGGTGACGGTGTC GTGGAACTCAGGCGCCCTGACCAGCGGCGTGCACACCTTCCCGGCTGTCCTACAGTCCTCAG GACTCTACTCCCTCAGCAGCGTGGTGACCGTGCCCTCCAGCAGCTTGGGCACCCAGACCTAC ATCTGCAACGTGAATCACAAGCCCAGCAACACCAAGGTGGACAAGAAAGTTGAGCCCAAAT CTTGTGACAAAACTCACACATGCCCACCGTGCCCAGCACCTGAACTCCTGGGGGGACCGTCA GTCTTCCTCTTCCCCCCAAAACCCAAGGACACCCTCATGATCTCCCGGACCCCTGAGGTCAC ATGCGTGGTGGTGGACGTGAGCCACGAAGACCCTGAGGTCAAGTTCAACTGGTACGTGGAC GGCGTGGAGGTGCATAATGCCAAGACAAAGCCGCGGGAGGAGCAGTACAACAGCACGTAC CGTGTGGTCAGCGTCCTCACCGTCCTGCACCAGGACTGGCTGAATGGCAAGGAGTACAAGTG CAAGGTCTCCAACAAAGCCCTCCCAGCCCCCATCGAGAAAACCATCTCCAAAGCCAAAGGG CAGCCCCGAGAACCACAGGTGTACACCCTGCCCCCATCCCGGGAGGAGATGACCAAGAACC AGGTCAGCCTGACCTGCCTGGTCAAAGGCTTCTATCCCAGCGACATCGCCGTGGAGTGGGAG AGCAATGGGCAGCCGGAGAACAACTACAAGACCACGCCTCCCGTGCTGGACTCCGACGGCT CCTTCTTCCTCTACAGCAAGCTCACCGTGGACAAGAGCAGGTGGCAGCAGGGGAACGTCTTC TCATGCTCCGTGATGCATGAGGCTCTGCACAACCACTACACGCAGAAGAGCCTCTCCCTGTC TCCGGGTAAA |
| SEQ ID NO: 560<br>GACATCGTGATGACCCAGAGCCCCGATAGCCTGGCTGTGAGCCTGGGAGAGAGGGC CACCATCAACTGCAAGAGCAGCCAGAGCGTGCTGTACAGCAGCAAGAACAAGAACTACCTG GCCTGGTACCAGCAGAAACCCGGCCAGCCCCCCAAGCTGCTGATCTACTGGGCCAGCACAA GGGAAAGCGGCGTGCCCGACAGATTCAGCGGAAGCGGCAGCGGCACCGACTTCACCCTGAC CATCAGCAGCCTGCAGGCCGAGGATGTGGCCGTGTACTACTGCCAGCAGTACTACAGCACCT TCCCCTACACCTTCGGCCAGGGCACCAAGCTGGAGATCAAGCGTACGGTGGCTGCACCATCT GTCTTCATCTTCCCGCCATCTGATGAGCAGTTGAAATCTGGAACTGCCTCTGTTGTGTGCCTG CTGAATAACTTCTATCCCAGAGAGGCCAAAGTACAGTGGAAGGTGGATAACGCCCTCCAAT CGGGTAACTCCCAGGAGAGTGTCACAGAGCAGGACAGCAAGGACAGCACCTACAGCCTCAG CAGCACCCTGACGCTGAGCAAAGCAGACTACGAGAAACACAAAGTCTACGCCTGCGAAGTC ACCCATCAGGGCCTGAGCTCGCCCGTCACAAAGAGCTTCAACAGGGGAGAGTGT |
| SEQ ID NO: 561<br>CAGGTGCAGCTGCAGCAGAGCGGACCCGGACTGGTGAGACCCAGCCAGACCCTGAG CGTGACCTGCGCCATCAGCGGCGACAGCGTGAGCAGCAACAGCGCCAGCTGGAACTGGATC AGGCAGAGCCCCAGCAGAGGCCTGGAGTGGCTGGGAAGGACATACTACAGGAGCGAGTGG TTCAACGACTACGCCGTGAGCGTGAAGAGCAGGGTGACCATCAACCCCGACACCAGCAAGA ACCAGCTGAGCCTGCAGCTGAACAGCGTGATCCCCGAGGACACCGCCGTGTACTACTGCGCC AGAGAGGCCAGAATCGGCGTGGCCGGCAAAGGCTTCGACTACTGGGGCCAGGGCACCCTGG TGACAGTGTCCAGCGCCTCCACCAAGGGCCCATCGGTCTTCCCCCTGGCACCCTCCTCCAAG AGCACCTCTGGGGGCACAGCGGCCCTGGGCTGCCTGGTCAAGGACTACTTCCCCGAACCGGT GACGGTGTCGTGGAACTCAGGCGCCCTGACCAGCGGCGTGCACACCTTCCCGGCTGTCCTAC AGTCCTCAGGACTCTACTCCCTCAGCAGCGTGGTGACCGTGCCCTCCAGCAGCTTGGGCACC CAGACCTACATCTGCAACGTGAATCACAAGCCCAGCAACACCAAGGTGGACAAGAAAGTTG |

TABLE 54-continued

SEQ ID Nos of the cDNA sequences of HC and LC of selected HLA-G antibodies

AGCCCAAATCTTGTGACAAAACTCACACATGCCCACCGTGCCCAGCACCTGAACTCCTGGGG
GGACCGTCAGTCTTCCTCTTCCCCCCAAAACCCAAGGACACCCTCATGATCTCCCGGACCCC
TGAGGTCACATGCGTGGTGGTGGACGTGAGCCACGAAGACCCTGAGGTCAAGTTCAACTGG
TACGTGGACGGCGTGGAGGTGCATAATGCCAAGACAAAGCCGCGGGAGGAGCAGTACAAC
AGCACGTACCGTGTGGTCAGCGTCCTCACCGTCCTGCACCAGGACTGGCTGAATGGCAAGGA
GTACAAGTGCAAGGTCTCCAACAAAGCCCTCCCAGCCCCCATCGAGAAAACCATCTCCAAA
GCCAAAGGGCAGCCCCGAGAACCACAGGTGTACACCCTGCCCCCATCCCGGGAGGAGATGA
CCAAGAACCAGGTCAGCCTGACCTGCCTGGTCAAAGGCTTCTATCCCAGCGACATCGCCGTG
GAGTGGGAGAGCAATGGGCAGCCGGAGAACAACTACAAGACCACGCCTCCCGTGCTGGACT
CCGACGGCTCCTTCTTCCTCTACAGCAAGCTCACCGTGGACAAGAGCAGGTGGCAGCAGGG
GAACGTCTTCTCATGCTCCGTGATGCATGAGGCTCTGCACAACCACTACACGCAGAAGAGCC
TCTCCCTGTCTCCGGGTAAA

SEQ ID NO: 562
GACATCGTGATGACCCAGAGCCCTGACTCCCTGGCTGTGAGCCTGGGCGAGAGAGCC
ACCATCAACTGCAAGAGCAGCCAGAGCGTGCTGTTCAGGAGCAACAACAAGAACTACCTGG
CCTGGTTCCAGCAGAAGCCCGGCCAGCCTCCCAAGCTGCTGATCTACTGGGCCAGCACCAGA
GAGAGCGGCGTGCCCGATAGATTTAGCGGCAGCGGCAGCGGCACCGACTTTACCCTGACCA
TCAGCTCCCTGCAGGCCGAGGATGTGGCCGTGTACTACTGCCAGCAGTACTACAGCACCCCC
AGAACCTTCGGCCAGGGCACCAAGGTGGAGATCAAGCGTACGGTGGCTGCACCATCTGTCTT
CATCTTCCCGCCATCTGATGAGCAGTTGAAATCTGGAACTGCCTCTGTTGTGTGCCTGCTGAA
TAACTTCTATCCCAGAGAGGCCAAAGTACAGTGGAAGGTGGATAACGCCCTCCAATCGGGT
AACTCCCAGGAGAGTGTCACAGAGCAGGACAGCAAGGACAGCACCTACAGCCTCAGCAGCA
CCCTGACGCTGAGCAAAGCAGACTACGAGAAACACAAAGTCTACGCCTGCGAAGTCACCCA
TCAGGGCCTGAGCTCGCCCGTCACAAAGAGCTTCAACAGGGGAGAGTGT

SEQ ID NO: 563
CAGGTGCAGCTGCAGCAGAGCGGACCTGGCCTGGTGAAGCCCAGCCAGACCCTGAG
CCTGACATGCGCCATCAGCGGCGACAGCGTGAGCAGCAATAGGGCCGCCTGGAACTGGATC
AGGCAGACCCCTAGCAGGGGCCTGGAATGGCTGGGCAGGACATACTACAGGAGCGAGTGGT
ACAACGACTACGCCGTGTCCGTGAAGAGCAGGATCACCATCAACCCCGACACCAGCAAGAA
CCAGTTCAGCCTGCAGCTGAACAGCGTGACCCCCGAGGACACCGCCGTGTACTACTGCGCCA
GAGTGAGAGCCGCCGTGCCTTTCGACTACTGGGGCCAGGGCACCCTGGTGACAGTGAGCAG
CGCCTCCACCAAGGGCCCATCGGTCTTCCCCCTGGCACCCTCCTCCAAGAGCACCTCTGGGG
GCACAGCGGCCCTGGGCTGCCTGGTCAAGGACTACTTCCCCGAACCGGTGACGGTGTCGTGG
AACTCAGGCGCCCTGACCAGCGGCGTGCACACCTTCCCGGCTGTCCTACAGTCCTCAGGACT
CTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAAAGTTGAGCCCAAATCTTG
TGACAAAACTCACACATGCCCACCGTGCCCAGCACCTGAACTCCTGGGGGGACCGTCAGTCT
TCCTCTTCCCCCCAAAACCCAAGGACACCCTCATGATCTCCCGGACCCCTGAGGTCACATGC
GTGGTGGTGGACGTGAGCCACGAAGACCCTGAGGTCAAGTTCAACTGGTACGTGGACGGCG
TGGAGGTGCATAATGCCAAGACAAAGCCGCGGGAGGAGCAGTACAACAGCACGTACCGTGT
GGTCAGCGTCCTCACCGTCCTGCACCAGGACTGGCTGAATGGCAAGGAGTACAAGTGCAAG
GTCTCCAACAAAGCCCTCCCAGCCCCCATCGAGAAAACCATCTCCAAAGCCAAAGGGCAGC
CCCGAGAACCACAGGTGTACACCCTGCCCCCATCCCGGGAGGAGATGACCAAGAACCAGGT
CAGCCTGACCTGCCTGGTCAAAGGCTTCTATCCCAGCGACATCGCCGTGGAGTGGGAGAGCA
ATGGGCAGCCGGAGAACAACTACAAGACCACGCCTCCCGTGCTGGACTCCGACGGCTCCTTC
TTCCTCTACAGCAAGCTCACCGTGGACAAGAGCAGGTGGCAGCAGGGGAACGTCTTCTCATG
CTCCGTGATGCATGAGGCTCTGCACAACCACTACACGCAGAAGAGCCTCTCCCTGTCTCCGG
GTAAA

SEQ ID NO: 564
GACATCGTGATGACCCAGAGCCCCGATAGCCTGGCTGTGAGCCTGGGCGAGAGGGC
CACCATCAACTGCAAGAGCAGCCAGAGCGTGCTGTTTTCCAGCAACAACAAGAACTACCTG
GCCTGGTACCAGCAGAAACCCGGCCAGCCCCCCAACCTGCTGATCTACTGGGCCAGCACCA
GAGAAAGCGGCGTGCCCGACAGGTTTAGCGGCAGCGTGAGCGGCACCGACTTCACCCTGAC
CATCAGCAGCCTGCAGGCCGAGGACGTGGCCATCTACTACTGCCAGCAGTACCACAGCACC
CCCTGGACATTCGGCCAGGGCACCAAGGTGGAGATCAAGCGTACGGTGGCTGCACCATCTG
TCTTCATCTTCCCGCCATCTGATGAGCAGTTGAAATCTGGAACTGCCTCTGTTGTGTGCCTGC
TGAATAACTTCTATCCCAGAGAGGCCAAAGTACAGTGGAAGGTGGATAACGCCCTCCAATC
GGGTAACTCCCAGGAGAGTGTCACAGAGCAGGACAGCAAGGACAGCACCTACAGCCTCAGC
AGCACCCTGACGCTGAGCAAAGCAGACTACGAGAAACACAAAGTCTACGCCTGCGAAGTCA
CCCATCAGGGCCTGAGCTCGCCCGTCACAAAGAGCTTCAACAGGGGAGAGTGT

SEQ ID NO: 565
CAGCTGCAGCTGCAGGAGAGCGGCCCTGGACTGGTGAAGCCCAGCGAGACCCTGAG
CCTGATGTGCACCGTGAGCGGCGGCAGCATCACCAGCAGCAGCTACTACTGGGGATGGATC
AGACAGCCCCCTGGCAAGGGCCTGGAGTGGATCGGCAACATCTACTACAGCGGCACCACCT
ACTACAACCCCAGCCTGAAGAGCAGGGTGACCATCAGCGTGGACACCAGCAAGAACCAGTT
CAGCCTGAAGCTGAGCAGCGTGACAGCTGCCGACACCGCCGTGTACTACTGTGCCGCCGGA
GCCAGAGACTTCGACAGCTGGGGACAGGGCAGCCTGGTGACCGTGTCCAGCGCCTCCACCA
AGGGCCCATCGGTCTTCCCCCTGGCACCCTCCTCCAAGAGCACCTCTGGGGGCACAGCGGCC
CTGGGCTGCCTGGTCAAGGACTACTTCCCCGAACCGGTGACGGTGTCGTGGAACTCAGGCGC
CCTGACCAGCGGCGTGCACACCTTCCCGGCTGTCCTACAGTCCTCAGGACTCTACTCCCTCA
GCAGCGTGGTGACCGTGCCCTCCAGCAGCTTGGGCACCCAGACCTACATCTGCAACGTGAAT
CACAAGCCCAGCAACACCAAGGTGGACAAGAAAGTTGAGCCCAAATCTTGTGACAAAACTC
ACACATGCCCACCGTGCCCAGCACCTGAACTCCTGGGGGGACCGTCAGTCTTCCTCTTCCCC

TABLE 54-continued

SEQ ID Nos of the cDNA sequences of HC and LC of selected HLA-G antibodies

CCAAAACCCAAGGACACCCTCATGATCTCCCGGACCCCTGAGGTCACATGCGTGGTGGTGGA
CGTGAGCCACGAAGACCCTGAGGTCAAGTTCAACTGGTACGTGGACGGCGTGGAGGTGCAT
AATGCCAAGACAAAGCCGCGGGAGGAGCAGTACAACAGCACGTACCGTGTGGTCAGCGTCC
TCACCGTCCTGCACCAGGACTGGCTGAATGGCAAGGAGTACAAGTGCAAGGTCTCCAACAA
AGCCCTCCCAGCCCCCATCGAGAAAACCATCTCCAAAGCCAAAGGGCAGCCCCGAGAACCA
CAGGTGTACACCCTGCCCCCATCCCGGGAGGAGATGACCAAGAACCAGGTCAGCCTGACCT
GCCTGGTCAAAGGCTTCTATCCCAGCGACATCGCCGTGGAGTGGGAGAGCAATGGGCAGCC
GGAGAACAACTACAAGACCACGCCTCCCGTGCTGGACTCCGACGGCTCCTTCTTCCTCTACA
GCAAGCTCACCGTGGACAAGAGCAGGTGGCAGCAGGGGAACGTCTTCTCATGCTCCGTGAT
GCATGAGGCTCTGCACAACCACTACACGCAGAAGAGCCTCTCCCTGTCTCCGGGTAAA

SEQ ID NO: 566
GACATCGTGATGACCCAGAGCCCTGATAGCCTGGCCGTGAGCCTGGGAGAGAGAGC
CACCATCAACTGCAAGTCCTCCCAGAGCGTGCTGTACAGCTCCAGCAACAAGAGCTACCTGG
CCTGGTACCAGCAGAGGCCCGGACAGCCTCCCAAGCTGCTGATCTACTGGGCCAGCACCAG
AGAGAGCGGCGTGCCTGACAGGTTTAGCGGCTCCGGCTCCGGCACCGACTTTACCCTGACCA
TCAGCAGCCTGCAGGCCGAGGATGTGGCCGTGTACTACTGCCAGCAGTACTACAGCACCCCC
AGGATGTACACCTTCGGCCAGGGCACCAAGCTGGAGATCAAGCGTACGGTGGCTGCACCAT
CTGTCTTCATCTTCCCGCCATCTGATGAGCAGTTGAAATCTGGAACTGCCTCTGTTGTGTGCC
TGCTGAATAACTTCTATCCCAGAGAGGCCAAAGTACAGTGGAAGGTGGATAACGCCCTCCA
ATCGGGTAACTCCCAGGAGAGTGTCACAGAGCAGGACAGCAAGGACAGCACCTACAGCCTC
AGCAGCACCCTGACGCTGAGCAAAGCAGACTACGAGAAACACAAAGTCTACGCCTGCGAAG
TCACCCATCAGGGCCTGAGCTCGCCCGTCACAAAGAGCTTCAACAGGGGAGAGTGT

SEQ ID NO: 567
GAGGTGCAGCTGTTGGAGTCAGGTCCAGGACTGGTGAAGCCCTCGCAGACCCTCTCA
CTCACCTGTGTCATCTCCGGGGACAGTGTCTCTAGCAACAGAGCTGCTTGGAACTGGATCAG
GCAGTCCCCATCGAGAGGCCTTGAGTGGCTGGGAAGGACATACTACAGGTCCAAGTGGTAT
AATGATTATGCAGTATCTGTGAAAAGTCGAATAACCATCAATTCAGACACATCCAAGAACCA
GATCTCCCTGCAGTTGAACTCTGTGACTCCCGAGGACACGGCTGTGTATTACTGTGCAAGAG
TGAGACCGGGGATCCCATTTGACTACTGGGGCCAGGGAACCCCGGTCACCGTCTCCTCAGCC
TCCACCAAGGGCCCATCGGTCTTCCCCCTGGCACCCTCCTCCAAGAGCACCTCTGGGGGCAC
AGCGGCCCTGGGCTGCCTGGTCAAGGACTACTTCCCCGAACCGGTGACGGTGTCGTGGAACT
CAGGCGCCCTGACCAGCGGCGTGCACACCTTCCCGGCTGTCCTACAGTCCTCAGGACTCTAC
TCCCTCAGCAGCGTGGTGACCGTGCCCTCCAGCAGCTTGGGCACCCAGACCTACATCTGCAA
CGTGAATCACAAGCCCAGCAACACCAAGGTGGACAAGAAAGTTGAGCCCAAATCTTGTGAC
AAAACTCACACATGCCCACCGTGCCCAGCACCTGAACTCCTGGGGGGACCGTCAGTCTTCCT
CTTCCCCCCAAAACCCAAGGACACCCTCATGATCTCCCGGACCCCTGAGGTCACATGCGTGG
TGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGTGTGGTC
AGCGTCCTCACCGTCCTGCACCAGGACTGGCTGAATGGCAAGGAGTACAAGTGCAAGGTCT
CCAACAAAGCCCTCCCAGCCCCCATCGAGAAAACCATCTCCAAAGCCAAAGGGCAGCCCCG
AGAACCACAGGTGTACACCCTGCCCCCATCCCGGGAGGAGATGACCAAGAACCAGGTCAGC
CTGACCTGCCTGGTCAAAGGCTTCTATCCCAGCGACATCGCCGTGGAGTGGGAGAGCAATGG
GCAGCCGGAGAACAACTACAAGACCACGCCTCCCGTGCTGGACTCCGACGGCTCCTTCTTCC
TCTACAGCAAGCTCACCGTGGACAAGAGCAGGTGGCAGCAGGGGAACGTCTTCTCATGCTC
CGTGATGCATGAGGCTCTGCACAACCACTACACGCAGAAGAGCCTCTCCCTGTCTCCGGGTA
AA

SEQ ID NO: 568
GACATCGTGATGACCCAGTCTCCAGACTCCCTGGCTGTGTCTCTGGGCGAGAGGGCC
ACCATCAACTGCAAGTCCAGCCAGAGTGTTTTATTCAGCTCCAACAAAAAGAACTACTTAGC
TTGGTACCAGCAGAAACCAGGACAGCCCCCTAAGCTGCTCATTTACTGGGCATCTACCCGGG
AATCCGGGGTCCCTGACCGATTCAGTGGCAGCGGGTCTGGGACAGATTTCACTCTCACCATC
AGCAGCCTGCAGGCTGAAGATGTGGCAGTTTATTACTGTCAGCAATATAATAGTACTCCGTG
GACGTTCGGCCAAGGGACCAAGGTGGAGATCAAACGTACGGTGGCTGCACCATCTGTCTTC
ATCTTCCCGCCATCTGATGAGCAGTTGAAATCTGGAACTGCCTCTGTTGTGTGCCTGCTGAAT
AACTTCTATCCCAGAGAGGCCAAAGTACAGTGGAAGGTGGATAACGCCCTCCAATCGGGTA
ACTCCCAGGAGAGTGTCACAGAGCAGGACAGCAAGGACAGCACCTACAGCCTCAGCAGCAC
CCTGACGCTGAGCAAAGCAGACTACGAGAAACACAAAGTCTACGCCTGCGAAGTCACCCAT
CAGGGCCTGAGCTCGCCCGTCACAAAGAGCTTCAACAGGGGAGAGTGT

SEQ ID NO: 569
CAGGTACAGCTGCAGCAGTCAGGTCCAGGACTGGTGAAGCCCTCGCAGACCCTCTCA
CTCACCTGTGTCATCTCCGGGGACAGTGTCTCTAGCAACAGAGCTGCCTGGAACTGGATCAG
GCAGTCCCCATCGAGAGGCCTTGAGTGGCTGGGAAGGACATACTACAGGTCCAAGTGGTAT
AATGATTATGCAGTTTCTGTGAAAAGTCGAATAACCATCAATTCAGACACATCCAAGAACCA
GATCTCCCTGCAGTTGAACTCTGTGACTCCCGAGGACACGGCTGTGTATTACTGTGCAAGAG
TGAGACCGGGGATCCCTTTTGACTACTGGGGCCAGGGAACCACGGTCACCGTCTCCTCAGCC
TCCACCAAGGGCCCATCGGTCTTCCCCCTGGCACCCTCCTCCAAGAGCACCTCTGGGGGCAC
AGCGGCCCTGGGCTGCCTGGTCAAGGACTACTTCCCCGAACCGGTGACGGTGTCGTGGAACT
CAGGCGCCCTGACCAGCGGCGTGCACACCTTCCCGGCTGTCCTACAGTCCTCAGGACTCTAC
TCCCTCAGCAGCGTGGTGACCGTGCCCTCCAGCAGCTTGGGCACCCAGACCTACATCTGCAA
CGTGAATCACAAGCCCAGCAACACCAAGGTGGACAAGAAAGTTGAGCCCAAATCTTGTGAC
AAAACTCACACATGCCCACCGTGCCCAGCACCTGAACTCCTGGGGGGACCGTCAGTCTTCCT
CTTCCCCCCAAAACCCAAGGACACCCTCATGATCTCCCGGACCCCTGAGGTCACATGCGTGG
TGGTGGACGTGAGCCACGAAGACCCTGAGGTCAAGTTCAACTGGTACGTGGACGGCGTGGA

TABLE 54-continued

| SEQ ID Nos of the cDNA sequences of HC and LC of selected HLA-G antibodies |
|---|
| GGTGCATAATGCCAAGACAAAGCCGCGGGAGGAGCAGTACAACAGCACGTACCGTGTGGTC AGCGTCCTCACCGTCCTGCACCAGGACTGGCTGAATGGCAAGGAGTACAAGTGCAAGGTCT CCAACAAAGCCCTCCCAGCCCCCATCGAGAAAACCATCTCCAAAGCCAAAGGGCAGCCCCG AGAACCACAGGTGTACACCCTGCCCCCATCCCGGGAGGAGATGACCAAGAACCAGGTCAGC CTGACCTGCCTGGTCAAAGGCTTCTATCCCAGCGACATCGCCGTGGAGTGGGAGAGCAATGG GCAGCCGGAGAACAACTACAAGACCACGCCTCCCGTGCTGGACTCCGACGGCTCCTTCTTCC TCTACAGCAAGCTCACCGTGGACAAGAGCAGGTGGCAGCAGGGGAACGTCTTCTCATGCTC CGTGATGCATGAGGCTCTGCACAACCACTACACGCAGAAGAGCCTCTCCCTGTCTCCGGGTA AA |
| SEQ ID NO: 570 GACATCCAGATGACCCAGTCTCCAGACTCCCTGGCTGTGTCTCTGGGCGAGAGGGCC ACCATCAACTGCGAGTCCAGCCAGAGTGTTTTATTCAGCTCCAACAAAAAGAACTACTTAGC TTGGTACCAGCAGAAACCAGGACAGCCCCCTAAGCTGCTCATTTACTGGGCATCTACCCGGG AATCCGGGGTCCCTGACCGATTCAGTGGCAGCGGGTCTGGGACAGATTTCACTCTCACCATC AACCGCCTGCAGGCTGAAGATGTGGCAGTTTATTACTGTCAGCAATATAATAGTACTCCGTG GACGTTCGGCCAAGGGACCAAGGTGGAGATCAAACGTACGGTGGCTGCACCATCTGTCTTC ATCTTCCCGCCATCTGATGAGCAGTTGAAATCTGGAACTGCCTCTGTTGTGTGCCTGCTGAAT AACTTCTATCCCAGAGAGGCCAAAGTACAGTGGAAGGTGGATAACGCCCTCCAATCGGGTA ACTCCCAGGAGAGTGTCACAGAGCAGGACAGCAAGGACAGCACCTACAGCCTCAGCAGCAC CCTGACGCTGAGCAAAGCAGACTACGAGAAACACAAAGTCTACGCCTGCGAAGTCACCCAT CAGGGCCTGAGCTCGCCCGTCACAAAGAGCTTCAACAGGGGAGAGTGT |
| SEQ ID NO: 571 GAGGTGCAGCTGTTGGAGTCTGGGGGAGGCTTGGTACAGCCTGGGGGGTCCCTGAG ACTCTCCTGTGCAGCCTCTGGATTCACCTTTAGCAGCTATGCCATGCACTGGGTCCGCCAGGC CCCAGGGAAGGGGCTGGACTGGGTCTCAGGTATTAGTGGTAGTGGCTTTAGCACATACTATG TAGACTCCGTGAAGGGCCGGTTCACCATCTCCAGAGACAATTCCAAGCACACGCTGTATCTG CAAATGAACAGCCTGAGAGCCGAGGACACGGCCGTATATTACTGTGCGAAAGATAATTTAG TGGCTGGTACCGTCTTTGACTACTGGGGCCAGGGAACCCTGGTCACCGTCTCCTCAGCCTCC ACCAAGGGCCCATCGGTCTTCCCCCTGGCACCCTCCTCCAAGAGCACCTCTGGGGGCACAGC GGCCCTGGGCTGCCTGGTCAAGGACTACTTCCCCGAACCGGTGACGGTGTCGTGGAACTCAG GCGCCCTGACCAGCGGCGTGCACACCTTCCCGGCTGTCCTACAGTCCTCAGGACTCTACTCC CTCAGCAGCGTGGTGACCGTGCCCTCCAGCAGCTTGGGCACCCAGACCTACATCTGCAACGT GAATCACAAGCCCAGCAACACCAAGGTGGACAAGAAAGTTGAGCCCAAATCTTGTGACAAA ACTCACACATGCCCACCGTGCCCAGCACCTGAACTCCTGGGGGGACCGTCAGTCTTCCTCTT CCCCCCAAAACCCAAGGACACCCTCATGATCTCCCGGACCCCTGAGGTCACATGCGTGGTGG TGGACGTGAGCCACGAAGACCCTGAGGTCAAGTTCAACTGGTACGTGGACGGCGTGGAGGT GCATAATGCCAAGACAAAGCCGCGGGAGGAGCAGTACAACAGCACGTACCGTGTGGTCAGC GTCCTCACCGTCCTGCACCAGGACTGGCTGAATGGCAAGGAGTACAAGTGCAAGGTCTCCA ACAAAGCCCTCCCAGCCCCCATCGAGAAAACCATCTCCAAAGCCAAAGGGCAGCCCCGAGA ACCACAGGTGTACACCCTGCCCCCATCCCGGGAGGAGATGACCAAGAACCAGGTCAGCCTG ACCTGCCTGGTCAAAGGCTTCTATCCCAGCGACATCGCCGTGGAGTGGGAGAGCAATGGGC AGCCGGAGAACAACTACAAGACCACGCCTCCCGTGCTGGACTCCGACGGCTCCTTCTTCCTC TACAGCAAGCTCACCGTGGACAAGAGCAGGTGGCAGCAGGGGAACGTCTTCTCATGCTCCG TGATGCATGAGGCTCTGCACAACCACTACACGCAGAAGAGCCTCTCCCTGTCTCCGGGTAAA |
| SEQ ID NO: 572 GACATCCAGATGACCCAGTCTCCTTCCACCCTGTCTGCATCTGTAGGAGACAGAGTC ACCATCACTTGCCGGGCCAGTCAGAGTATTAGTAGCTGGTTGGCCTGGTATCAGCAGAAACC AGGGAAAGCCCCTAAGCTCCTGATCTATAAGGCGTCTAGTTTAGAAAGTGGGGTCCCATCAA GGTTCAGCGGCAGTGGATCTGGGACAGAATTCACTCTCACCATCAGCAGCCTGCAGCCTGAT GATTTTGCAACTTATTACTGCCAACAGTATAATAGTTATTCGCTCACTTTCGGCGGAGGGACC AAGGTGGATATCAAACGTACGGTGGCTGCACCATCTGTCTTCATCTTCCCGCCATCTGATGA GCAGTTGAAATCTGGAACTGCCTCTGTTGTGTGCCTGCTGAATAACTTCTATCCCAGAGAGG CCAAAGTACAGTGGAAGGTGGATAACGCCCTCCAATCGGGTAACTCCCAGGAGAGTGTCAC AGAGCAGGACAGCAAGGACAGCACCTACAGCCTCAGCAGCACCCTGACGCTGAGCAAAGCA GACTACGAGAAACACAAAGTCTACGCCTGCGAAGTCACCCATCAGGGCCTGAGCTCGCCCG TCACAAAGAGCTTCAACAGGGGAGAGTGT |
| SEQ ID NO: 573 CAAGTACAACTGCAACAAAGTGGTCCTGGGCTCGTGAAGCCTTCCCAGACTCTCAGC CTCACATGCGCTATAAGTGGGGATTCTGTTTCCTCAAATTCAGCAGCCTGGAATTGGATACG ACAGTCTCCATCCCGTGGCCTTGAGTGGCTTGGTAGAACTTATTACCGATCCAAGTGGTACA ATGATTACGCCGTTTCAGTGAAGTCCCGCATTACTATTAATCCCGACACATCTAAGAATCAA ATTTCATTGCAACTGAATAGCGTAACACCCGAAGATACAGCAGTTTATTATTGTGCAGGTGA TCGACGCTACGGCATAGTGGGACTTCCTTTCGCCTATTGGGGCCAAGGGACACTGGTCACTG TGTCATCCGCCTCCACCAAGGGCCCATCGGTCTTCCCCCTGGCACCCTCCTCCAAGAGCACCT CTGGGGGCACAGCGGCCCTGGGCTGCCTGGTCAAGGACTACTTCCCCGAACCGGTGACGGT GTCGTGGAACTCAGGCGCCCTGACCAGCGGCGTGCACACCTTCCCGGCTGTCCTACAGTCCT CAGGACTCTACTCCCTCAGCAGCGTGGTGACCGTGCCCTCCAGCAGCTTGGGCACCCAGACC TACATCTGCAACGTGAATCACAAGCCCAGCAACACCAAGGTGGACAAGAAAGTTGAGCCCA AATCTTGTGACAAAACTCACACATGTCCACCGTGCCCAGCACCTGAACTGCTGGGGGGACCG TCAGTCTTCCTCTTCCCCCCAAAACCCAAGGACACCCTCATGATCTCCCGGACCCCTGAGGTC ACATGCGTGGTGGTGGACGTGAGCCACGAAGACCCTGAGGTCAAGTTCAACTGGTACGTGG ACGGCGTGGAGGTGCATAATGCCAAGACAAAGCCGCGGGAGGAGCAGTACAACAGCACGT ACCGTGTGGTCAGCGTCCTCACCGTCCTGCACCAGGACTGGCTGAATGGCAAGGAGTACAA |

TABLE 54-continued

| SEQ ID Nos of the cDNA sequences of HC and LC of selected HLA-G antibodies |
|---|
| GTGCAAGGTCTCCAACAAAGCCCTCCCAGCCCCCATCGAGAAAACCATCTCCAAAGCCAAA<br>GGGCAGCCCCGAGAACCACAGGTGTACACCCTGCCCCCATCCCGGGAGGAGATGACCAAGA<br>ACCAGGTCAGCCTGACCTGCCTGGTCAAAGGCTTCTATCCCAGCGACATCGCCGTGGAGTGG<br>GAGAGCAATGGGCAGCCGGAGAACAACTACAAGACCACGCCTCCCGTGCTGGACTCCGACG<br>GCTCCTTCTTCCTCTACAGCAAGCTCACCGTGGACAAGTCTAGATGGCAGCAGGGGAACGTC<br>TTCTCATGCTCCGTGATGCATGAGGCTCTGCACAACCACTACACGCAGAAGAGCCTCTCCCT<br>GTCTCCGGGT |
| SEQ ID NO: 574<br>GACATCGTAATGACACAGTCACCAGATTCATTGGCAGTTAGTCTGGGTGAAAGGGCA<br>ACAATCAACTGCAAGTCTTCTCAGAGTGTACTGCATAGTTCTAACAATAAGAACTACCTTAC<br>CTGGTTTCAACAGAAACCAGGTCAGCCCCCCAAGTTGCTGATTTACTGGGCAAGCACCCGCG<br>AATCCGGCGTTCCCGATCGATTTTCAGGTTCCGGGAGTGGGACCGACTTTACCTTGACCATCT<br>CTTCCTTGCAGGCCGAAGATGTAGCCGTCTATTACTGCCATCAGTATTACTCTACTCCCCCCA<br>CATTCGGTCAAGGTACAAAAGTTGAGATAAAACGGACAGTGGCCGCTCCTTCCGTGTTCATC<br>TTCCCACCTTCCGACGAGCAGCTGAAGTCCGGCACAGCTTCTGTCGTGTGCCTGCTGAACAA<br>CTTCTACCCTCGGGAAGCCAAGGTGCAGTGGAAGGTGGACAATGCCCTGCAGTCCGGCAAC<br>TCCCAAGAGTCTGTGACCGAGCAGGACTCCAAGGACAGCACCTACAGCCTGTCCTCCACACT<br>GACCCTGTCCAAGGCCGACTACGAGAAGCACAAGGTGTACGCCTGCGAAGTGACCCATCAG<br>GGCCTGTCTAGCCCTGTGACCAAGTCTTTCAACCGGGGCGAGTGT |
| SEQ ID NO: 575<br>GAGGTGCAACTCCTTGAATCAGGCGGAGGACTCGTCCAACCTGGAGGGAGTCTTAGG<br>CTTAGCTGTGCAGCCAGTGGCTTTACTTTTAGCAGCTATGCAATGCACTGGGTCAGGCAGGC<br>TCCTGGTAAGGGGCTCGAATGGGTCAGCGGCATATCCGGGTCAGGTTTCTCTACATATTATG<br>TCGATTCTGTAAAAGGACGATTCACCATATCCAGAGACAATTCTAAAAATACCTTGTATCTC<br>CAGATGAACAGCCTGAGAGCAGAAGATACCGCAGTTTATTACTGTGCAAAGGATAATCTGG<br>TTGCCGGGACAGTTTTTGATTATTGGGGGCAAGGCACCCTCGTCACAGTATCCAGTGCCTCC<br>ACCAAGGGCCCATCGGTCTTCCCCCTGGCACCCTCCTCCAAGAGCACCTCTGGGGGCACAGC<br>GGCCCTGGGCTGCCTGGTCAAGGACTACTTCCCCGAACCGGTGACGGTGTCGTGGAACTCAG<br>GCGCCCTGACCAGCGGCGTGCACACCTTCCCGGCTGTCCTACAGTCCTCAGGACTCTACTCC<br>CTCAGCAGCGTGGTGACCGTGCCCTCCAGCAGCTTGGGCACCCAGACCTACATCTGCAACGT<br>GAATCACAAGCCCAGCAACACCAAGGTGGACAAGAAAGTTGAGCCCAAATCTTGTGACAAA<br>ACTCACACATGTCCACCGTGCCCAGCACCTGAACTGCTGGGGGGACCGTCAGTCTTCCTCTT<br>CCCCCCAAAACCCAAGGACACCCTCATGATCTCCCGGACCCCTGAGGTCACATGCGTGGTGG<br>TGGACGTGAGCCACGAAGACCCTGAGGTCAAGTTCAACTGGTACGTGGACGGCGTGGAGGT<br>GCATAATGCCAAGACAAAGCCGCGGGAGGAGCAGTACAACAGCACGTACCGTGTGGTCAGC<br>GTCCTCACCGTCCTGCACCAGGACTGGCTGAATGGCAAGGAGTACAAGTGCAAGGTCTCCA<br>ACAAAGCCCTCCCAGCCCCCATCGAGAAAACCATCTCCAAAGCCAAAGGGCAGCCCCGAGA<br>ACCACAGGTGTACACCCTGCCCCCATCCCGGGAGGAGATGACCAAGAACCAGGTCAGCCTG<br>ACCTGCCTGGTCAAAGGCTTCTATCCCAGCGACATCGCCGTGGAGTGGGAGAGCAATGGGC<br>AGCCGGAGAACAACTACAAGACCACGCCTCCCGTGCTGGACTCCGACGGCTCCTTCTTCCTC<br>TACAGCAAGCTCACCGTGGACAAGTCTAGATGGCAGCAGGGGAACGTCTTCTCATGCTCCGT<br>GATGCATGAGGCTCTGCACAACCACTACACGCAGAAGAGCCTCTCCCTGTCTCCGGGT |
| SEQ ID NO: 576<br>GATATTCAGATGACTCAATCACCTTCAACCCTTAGCGCCTCCGTTGGAGATCGCGTTA<br>CCATTACCTGCCGAGCCTCCCAAAGTATCAGCTCATGGTTGGCATGGTATCAACAGAAGCCT<br>GGAAAGGCACCCAAACTTCTGATTTACAAAGCCAGCTCCTTGGAGTCAGGAGTCCCAAGCC<br>GGTTCAGCGGATCTGGGTCAGGGACAGAATTTACCCTGACCATATCTTCCCTTCAGCCCGAC<br>GACTTCGCCACTTACTATTGTCAGCAATACAACTCCTATTCCCTGACTTTCGGCGGTGGCACA<br>AAGGTTGACATCAAGCGGACAGTGGCCGCTCCTTCCGTGTTCATCTTCCCACCTTCCGACGA<br>GCAGCTGAAGTCCGGCACAGCTTCTGTCGTGTGCCTGCTGAACAACTTCTACCCTCGGGAAG<br>CCAAGGTGCAGTGGAAGGTGGACAATGCCCTGCAGTCCGGCAACTCCCAAGAGTCTGTGAC<br>CGAGCAGGACTCCAAGGACAGCACCTACAGCCTGTCCTCCACACTGACCCTGTCCAAGGCCG<br>ACTACGAGAAGCACAAGGTGTACGCCTGCGAAGTGACCCATCAGGGCCTGTCTAGCCCTGT<br>GACCAAGTCTTTCAACCGGGGCGAGTGT |
| SEQ ID NO: 577<br>CAGGTGCAGCTTCAACAGAGCGGACCTGGTCTGGTTAAGCCTTCCCAAACCCTGAGC<br>CTGACTTGTGCTATTTCCGGGGATAGTGTTAGCTCCAATAGGGCAGCATGGAACTGGATCAG<br>ACAGTCCCCAAGCCGTGGACTTGAGTGGCTTGGACGTACTTATTACAGGAGTAAATGGTACA<br>ATGATTATGCCGTTTCTGTGAAGAGCCGTATTACTATAAACCCAGATACTTCTAAAAATCAA<br>ATTTCCCTTCAGCTCAACTCAGTTACACCAGAGGATACTGCAGTCTATTATTGCGCAAGAGTT<br>CGACCTGGCATTCCCTTCGATTATTGGGGGCAGGGGACACCCGTTACTGTGTCCTCAGCCTC<br>CACCAAGGGCCCATCGGTCTTCCCCCTGGCACCCTCCTCCAAGAGCACCTCTGGGGGCACAG<br>CGGCCCTGGGCTGCCTGGTCAAGGACTACTTCCCCGAACCGGTGACGGTGTCGTGGAACTCA<br>GGCGCCCTGACCAGCGGCGTGCACACCTTCCCGGCTGTCCTACAGTCCTCAGGACTCTACTC<br>CCTCAGCAGCGTGGTGACCGTGCCCTCCAGCAGCTTGGGCACCCAGACCTACATCTGCAACG<br>TGAATCACAAGCCCAGCAACACCAAGGTGGACAAGAAAGTTGAGCCCAAATCTTGTGACAA<br>AACTCACACATGTCCACCGTGCCCAGCACCTGAACTGCTGGGGGGACCGTCAGTCTTCCTCT<br>TCCCCCCAAAACCCAAGGACACCCTCATGATCTCCCGGACCCCTGAGGTCACATGCGTGGTG<br>GTGGACGTGAGCCACGAAGACCCTGAGGTCAAGTTCAACTGGTACGTGGACGGCGTGGAGG<br>TGCATAATGCCAAGACAAAGCCGCGGGAGGAGCAGTACAACAGCACGTACCGTGTGGTCAG<br>CGTCCTCACCGTCCTGCACCAGGACTGGCTGAATGGCAAGGAGTACAAGTGCAAGGTCTCCA<br>ACAAAGCCCTCCCAGCCCCCATCGAGAAAACCATCTCCAAAGCCAAAGGGCAGCCCCGAGA<br>ACCACAGGTGTACACCCTGCCCCCATCCCGGGAGGAGATGACCAAGAACCAGGTCAGCCTG |

TABLE 54-continued

| SEQ ID Nos of the cDNA sequences of HC and LC of selected HLA-G antibodies |
|---|
| ACCTGCCTGGTCAAAGGCTTCTATCCCAGCGACATCGCCGTGGAGTGGGAGAGCAATGGGC AGCCGGAGAACAACTACAAGACCACGCCTCCCGTGCTGGACTCCGACGGCTCCTTCTTCCTC TACAGCAAGCTCACCGTGGACAAGTCTAGATGGCAGCAGGGGAACGTCTTCTCATGCTCCGT GATGCATGAGGCTCTGCACAACCACTACACGCAGAAGAGCCTCTCCCTGTCTCCGGGT |
| SEQ ID NO: 578 GATATTGTTATGACACAGTCCCCAGATTCATTGGCAGTAAGCCTCGGTGAACGGGCT ACTATTAACTGTAAGTCTTCCCAGAGTGTATTGTTCTCTTCAAATAACAAAAACTACCTGGCA TGGTATCAGCAAAAGCCTGGTCAACCCCCTAAACTTCTCATATACTGGGCATCCACTCGGGA GAGCGGTGTGCCAGACCGTTTCTCAGGGAGTGTGTCAGGTACAGATTTTACACTCACAATTT CCAGCCTCCAAGCCGAAGACGTTGCAGTATATTATTGCCAACAATATCACTCTACACCTTGG ACATTTGGTCAAGGTACTAAAGTCGAAATCAAACGGACAGTGGCCGCTCCTTCCGTGTTCAT CTTCCCACCTTCCGACGAGCAGCTGAAGTCCGGCACAGCTTCTGTCGTGTGCCTGCTGAACA ACTTCTACCCTCGGGAAGCCAAGGTGCAGTGGAAGGTGGACAATGCCCTGCAGTCCGGCAA CTCCCAAGAGTCTGTGACCGAGCAGGACTCCAAGGACAGCACCTACAGCCTGTCCTCCACAC TGACCCTGTCCAAGGCCGACTACGAGAAGCACAAGGTGTACGCCTGCGAAGTGACCCATCA GGGCCTGTCTAGCCCTGTGACCAAGTCTTTCAACCGGGGCGAGTGT |

TABLE 55

Amino acid sequences of the anti-HLA-G scFvs in VH-linker-VL (HL) or in VL-linker-VH (LH) format.

| Acronym | Amino acid sequence of scFv | SEQ ID NO: |
|---|---|---|
| MHGB665-HL | QVQLQQSGPGLVKPSQTLSLTCAISGDSVSSNSAAWNWIRQSPSRGLEWLGR TYYRSKWYNDYAVSVKSRITINPDTSKNQISLQLNSVTPEDTAVYYCAGDRRYGI VGLPFAYWGQGTLVTVSSGGSEGKSSGSGSESKSTGGSDIVMTQSPDSLAVSL GERATINCKSSQSVLHSSNNKNYLTWFQQKPGQPPKLLIYWASTRESGVPDRF SGSGSGTDFTLTISSLQAEDVAVYYCHQYYSTPPTFGQGTKVEIK | 579 |
| MHGB665-LH | DIVMTQSPDSLAVSLGERATINCKSSQSVLHSSNNKNYLTWFQQKPGQPPKLLI YWASTRESGVPDRFSGSGSGTDFTLTISSLQAEDVAVYYCHQYYSTPPTFGQGT KVEIKGGSEGKSSGSGSESKSTGGSQVQLQQSGPGLVKPSQTLSLTCAISGDSVS SNSAAWNWIRQSPSRGLEWLGRTYYRSKWYNDYAVSVKSRITINPDTSKNQIS LQLNSVTPEDTAVYYCAGDRRYGIVGLPFAYWGQGTLVTVSS | 580 |
| MHGB668-HL | QVQLQQSGPGLVKPSQTLSLTCAISGDSVSNNSAAWNWIRQSPSRGLEWLGR TYYRSKWYNDYAVSVKSRITINPDTSKNQFSLQLNSVTPEDTAVYYCARYGSGT LLFDYWGQGTLVTVSSGGSEGKSSGSGSESKSTGGSDIVMTQSPDSLAVSLGE RATINCKSSQSVLYSSKNKNYLAWYQQKPGQPPKLLIYWASTRESGVPDRFSGS GSGTDFTLTISSLQAEDVAVYYCQQYYSTFPYTFGQGTKLEIK | 581 |
| MHGB668-LH | DIVMTQSPDSLAVSLGERATINCKSSQSVLYSSKNKNYLAWYQQKPGQPPKLLI YWASTRESGVPDRFSGSGSGTDFTLTISSLQAEDVAVYYCQQYYSTFPYTFGQG TKLEIKGGSEGKSSGSGSESKSTGGSQVQLQQSGPGLVKPSQTLSLTCAISGDSV SNNSAAWNWIRQSPSRGLEWLGRTYYRSKWYNDYAVSVKSRITINPDTSKNQ FSLQLNSVTPEDTAVYYCARYGSGTLLFDYWGQGTLVTVSS | 582 |
| MHGB669-HL | QVQLQQSGPGLVRPSQTLSVTCAISGDSVSSNSASWNWIRQSPSRGLEWLGR TYYRSEWFNDYAVSVKSRVTINPDTSKNQLSLQLNSVIPEDTAVYYCAREARIG VAGKGFDYWGQGTLVTVSSGGSEGKSSGSGSESKSTGGSDIVMTQSPDSLAV SLGERATINCKSSQSVLFRSNNKNYLAWFQQKPGQPPKLLIYWASTRESGVPD RFSGSGSGTDFTLTISSLQAEDVAVYYCQQYYSTPRTFGQGTKVEIK | 583 |
| MHGB669-LH | DIVMTQSPDSLAVSLGERATINCKSSQSVLFRSNNKNYLAWFQQKPGQPPKLLI YWASTRESGVPDRFSGSGSGTDFTLTISSLQAEDVAVYYCQQYYSTPRTFGQGT KVEIKGGSEGKSSGSGSESKSTGGSQVQLQQSGPGLVRPSQTLSVTCAISGDSV SSNSASWNWIRQSPSRGLEWLGRTYYRSEWFNDYAVSVKSRVTINPDTSKNQ LSLQLNSVIPEDTAVYYCAREARIGVAGKGFDYWGQGTLVTVSS | 584 |
| MHGB672-HL | QVQLQQSGPGLVKPSQTLSLTCAISGDSVSSNRAAWNWIRQTPSRGLEWLGR TYYRSEWYNDYAVSVKSRITINPDTSKNQFSLQLNSVTPEDTAVYYCARVRAAV PFDYWGQGTLVTVSSGGSEGKSSGSGSESKSTGGSDIVMTQSPDSLAVSLGER ATINCKSSQSVLFSSNNKNYLAWYQQKPGQPPNLLIYWASTRESGVPDRFSGS VSGTDFTLTISSLQAEDVAIYYCQQYHSTPWTFGQGTKVEIK | 585 |
| MHGB672-LH | DIVMTQSPDSLAVSLGERATINCKSSQSVLFSSNNKNYLAWYQQKPGQPPNLLI YWASTRESGVPDRFSGSVSGTDFTLTISSLQAEDVAIYYCQQYHSTPVVTFGQG TKVEIKGGSEGKSSGSGSESKSTGGSQVQLQQSGPGLVKPSQTLSLTCAISGDS VSSNRAAWNWIRQTPSRGLEWLGRTYYRSEWYNDYAVSVKSRITINPDTSKN QFSLQLNSVTPEDTAVYYCARVRAAVPFDYWGQGTLVTVSS | 586 |

TABLE 55-continued

Amino acid sequences of the anti-HLA-G scFvs in VH-linker-VL (HL) or in VL-linker-VH (LH) format.

| Acronym | Amino acid sequence of scFv | SEQ ID NO: |
|---|---|---|
| MHGB687-HL | QLQLQESGPGLVKPSETLSLMCTVSGGSITSSSYYWGWIRQPPGKGLEWIGNIY<br>YSGTTYYNPSLKSRVTISVDTSKNQFSLKLSSVTAADTAVYYCAAGARDFDSWG<br>QGSLVTVSSGGSEGKSSGSGSESKSTGGSDIVMTQSPDSLAVSLGERATINCKS<br>SQSVLYSSSNKSYLAWYQQRPGQPPKLLIYWASTRESGVPDRFSGSGSGTDFTL<br>TISSLQAEDVAVYYCQQYYSTPRMYTFGQGTKLEIK | 587 |
| MHGB687-LH | DIVMTQSPDSLAVSLGERATINCKSSQSVLYSSSNKSYLAWYQQRPGQPPKLLI<br>YWASTRESGVPDRFSGSGSGTDFTLTISSLQAEDVAVYYCQQYYSTPRMYTFG<br>QGTKLEIKGGSEGKSSGSGSESKSTGGSQLQLQESGPGLVKPSETLSLMCTVSG<br>GSITSSSYYWGWIRQPPGKGLEWIGNIYYSGTTYYNPSLKSRVTISVDTSKNQFS<br>LKLSSVTAADTAVYYCAAGARDFDSWGQGSLVTVSS | 588 |
| MHGB688-HL | EVQLLESGPGLVKPSQTLSLTCVISGDSVSSNRAAWNWIRQSPSRGLEWLGRT<br>YYRSKWYNDYAVSVKSRITINSDTSKNQISLQLNSVTPEDTAVYYCARVRPGIPF<br>DYWGQGTPVTVSSGGSEGKSSGSGSESKSTGGSDIVMTQSPDSLAVSLGERAT<br>INCKSSQSVLFSSNKKNYLAWYQQKPGQPPKLLIYWASTRESGVPDRFSGSGS<br>GTDFTLTISSLQAEDVAVYYCQQYNSTPWTFGQGTKVEIK | 589 |
| MHGB688-LH | DIVMTQSPDSLAVSLGERATINCKSSQSVLFSSNKKNYLAWYQQKPGQPPKLLI<br>YWASTRESGVPDRFSGSGSGTDFTLTISSLQAEDVAVYYCQQYNSTPWTFGQG<br>TKVEIKGGSEGKSSGSGSESKSTGGSEVQLLESGPGLVKPSQTLSLTCVISGDSVS<br>SNRAAWNWIRQSPSRGLEWLGRTYYRSKWYNDYAVSVKSRITINSDTSKNQIS<br>LQLNSVTPEDTAVYYCARVRPGIPFDYWGQGTPVTVSS | 590 |
| MHGB689-HL | QVQLQQSGPGLVKPSQTLSLTCVISGDSVSSNRAAWNWIRQSPSRGLEWLGR<br>TYYRSKWYNDYAVSVKSRITINSDTSKNQISLQLNSVTPEDTAVYYCARVRPGIP<br>FDYWGQGTTVTVSSGGSEGKSSGSGSESKSTGGSDIQMTQSPDSLAVSLGERA<br>TINCESSQSVLFSSNKKNYLAWYQQKPGQPPKLLIYWASTRESGVPDRFSGSGS<br>GTDFTLTINRLQAEDVAVYYCQQYNSTPWTFGQGTKVEIK | 591 |
| MHGB689-LH | DIQMTQSPDSLAVSLGERATINCESSQSVLFSSNKKNYLAWYQQKPGQPPKLLI<br>YWASTRESGVPDRFSGSGSGTDFTLTINRLQAEDVAVYYCQQYNSTPWTFGQ<br>GTKVEIKGGSEGKSSGSGSESKSTGGSQVQLQQSGPGLVKPSQTLSLTCVISGD<br>SVSSNRAAWNWIRQSPSRGLEWLGRTYYRSKWYNDYAVSVKSRITINSDTSKN<br>QISLQLNSVTPEDTAVYYCARVRPGIPFDYWGQGTTVTVSS | 592 |
| MHGB694-HL | EVQLLESGGGLVQPGGSLRLSCAASGFTFSSYAMHWVRQAPGKGLDWVSGIS<br>GSGFSTYYVDSVKGRFTISRDNSKHTLYLQMNSLRAEDTAVYYCAKDNLVAGT<br>VFDYWGQGTLVTVSSGGSEGKSSGSGSESKSTGGSDIQMTQSPSTLSASVGDR<br>VTITCRASQSISSWLAWYQQKPGKAPKLLIYKASSLESGVPSRFSGSGSGTEFTL<br>TISSLQPDDFATYYCQQYNSYSLTFGGGTKVDIK | 593 |
| MHGB694-LH | DIQMTQSPSTLSASVGDRVTITCRASQSISSWLAWYQQKPGKAPKLLIYKASSL<br>ESGVPSRFSGSGSGTEFTLTISSLQPDDFATYYCQQYNSYSLTFGGGTKVDIKGG<br>SEGKSSGSGSESKSTGGSEVQLLESGGGLVQPGGSLRLSCAASGFTFSSYAMH<br>WVRQAPGKGLDWVSGISGSGFSTYYVDSVKGRFTISRDNSKHTLYLQMNSLR<br>AEDTAVYYCAKDNLVAGTVFDYWGQGTLVTVSS | 594 |
| MHGB732-HL | QVQLQQSGPGLVKPSQTLSLTCAISGDSVSSNSAAWNWIRQSPSRGLEWLGR<br>TYYRSKWYNDYAVSVKSRITINPDTSKNQISLQLNSVTPEDTAVYYCAGDRRYGI<br>VGLPFAYWGQGTLVTVSSGGSEGKSSGSGSESKSTGGSDIVMTQSPDSLAVSL<br>GERATINCKSSQSVLHSSNNKNYLTWFQQKPGQPPKLLIYWASTRESGVPDRF<br>SGSGSGTDFTLTISSLQAEDVAVYYCHQYYSTPPTFGQGTKVEIK | 595 |
| MHGB732-LH | DIVMTQSPDSLAVSLGERATINCKSSQSVLHSSNNKNYLTWFQQKPGQPPKLLI<br>YWASTRESGVPDRFSGSGSGTDFTLTISSLQAEDVAVYYCHQYYSTPPTFGQGT<br>KVEIKGGSEGKSSGSGSESKSTGGSQVQLQQSGPGLVKPSQTLSLTCAISGDSVS<br>SNSAAWNWIRQSPSRGLEWLGRTYYRSKWYNDYAVSVKSRITINPDTSKNQIS<br>LQLNSVTPEDTAVYYCAGDRRYGIVGLPFAYWGQGTLVTVSS | 596 |
| MHGB737-HL | EVQLLESGGGLVQPGGSLRLSCAASGFTFSSYAMHWVRQAPGKGEWVSGIS<br>GSGFSTYYVDSVKGRFTISRDNSKNTLYLQMNSLRAEDTAVYYCAKDNLVAGT<br>VFDYWGQGTLVTVSSGGSEGKSSGSGSESKSTGGSDIQMTQSPSTLSASVGDR<br>VTITCRASQSISSWLAWYQQKPGKAPKLLIYKASSLESGVPSRFSGSGSGTEFTL<br>TISSLQPDDFATYYCQQYNSYSLTFGGGTKVDIK | 597 |
| MHGB737-LH | DIQMTQSPSTLSASVGDRVTITCRASQSISSWLAWYQQKPGKAPKLLIYKASSL<br>ESGVPSRFSGSGSGTEFTLTISSLQPDDFATYYCQQYNSYSLTFGGGTKVDIKGG<br>SEGKSSGSGSESKSTGGSEVQLLESGGGLVQPGGSLRLSCAASGFTFSSYAMH<br>WVRQAPGKGLEWVSGISGSGFSTYYVDSVKGRFTISRDNSKNTLYLQMNSLRA<br>EDTAVYYCAKDNLVAGTVFDYWGQGTLVTVSS | 598 |

TABLE 55-continued

Amino acid sequences of the anti-HLA-G scFvs in VH-linker-VL (HL) or in VL-linker-VH (LH) format.

| Acronym | Amino acid sequence of scFv | SEQ ID NO: |
|---|---|---|
| MHGB738-HL | QVQLQQSGPGLVKPSQTLSLTCAISGDSVSSNRAAWNWIRQSPSRGLEWLGR TYYRSKWYNDYAVSVKSRITINPDTSKNQISLQLNSVTPEDTAVYYCARVRPGIP FDYWGQGTPVTVSSGGSEGKSSGSGSESKSTGGSDIVMTQSPDSLAVSLGERA TINCKSSQSVLFSSNNKNYLAWYQQKPGQPPKLLIYWASTRESGVPDRFSGSVS GTDFTLTISSLQAEDVAVYYCQQYHSTPWTFGQGTKVEIK | 599 |
| MHGB738-LH | DIVMTQSPDSLAVSLGERATINCKSSQSVLFSSNNKNYLAWYQQKPGQPPKLLI YWASTRESGVPDRFSGSVSGTDFTLTISSLQAEDVAVYYCQQYHSTPWTFGQG TKVEIKGGSEGKSSGSGSESKSTGGSQVQLQQSGPGLVKPSQTLSLTCAISGDS VSSNRAAWNWIRQSPSRGLEWLGRTYYRSKWYNDYAVSVKSRITINPDTSKN QISLQLNSVTPEDTAVYYCARVRPGIPFDYWGQGTPVTVSS | 600 |

TABLE 56

Amino acid sequences of the scFv-Fcs.

| Acronym | Amino acid sequence of scFv | SEQ ID NO: |
|---|---|---|
| MHGB665-HL-Fc | QVQLQQSGPGLVKPSQTLSLTCAISGDSVSSNSAAWNWIRQSPSRGLEWLGR TYYRSKWYNDYAVSVKSRITINPDTSKNQISLQLNSVTPEDTAVYYCAGDRRYGI VGLPFAYWGQGTLVTVSSGGSEGKSSGSGSESKSTGGSDIVMTQSPDSLAVSL GERATINCKSSQSVLHSSNNKNYLTWFQQKPGQPPKLLIYWASTRESGVPDRF SGSGSGTDFTLTISSLQAEDVAVYYCHQYYSTPPTFGQGTKVEIKEPKSSDKTHT CPPCPAPEAAGGPSVFLFPPKPKDTLMISRTPEVTCVVVSVSHEDPEVKFNWYV DGVEVHNAKTKPREEQYNSTYRVVSVLTVLHQDWLNGKEYKCKVSNKALPAPI EKTISKAKGQPREPQVYVLPPSREEMTKNQVSLLCLVKGFYPSDIAVEWESNGQ PENNYLTWPPVLDSDGSFFLYSKLTVDKSRWQQGNVFSCSVMHEALHNHYTQ KSLSLSPGK | 601 |
| MHGB665-LH-Fc | DIVMTQSPDSLAVSLGERATINCKSSQSVLHSSNNKNYLTWFQQKPGQPPKLLI YWASTRESGVPDRFSGSGSGTDFTLTISSLQAEDVAVYYCHQYYSTPPTFGQGT KVEIKGGSEGKSSGSGSESKSTGGSQVQLQQSGPGLVKPSQTLSLTCAISGDSVS SNSAAWNWIRQSPSRGLEWLGRTYYRSKWYNDYAVSVKSRITINPDTSKNQIS LQLNSVTPEDTAVYYCAGDRRYGIVGLPFAYWGQGTLVTVSSEPKSSDKTHTCP PCPAPEAAGGPSVFLFPPKPKDTLMISRTPEVTCVVVSVSHEDPEVKFNWYVD GVEVHNAKTKPREEQYNSTYRVVSVLTVLHQDWLNGKEYKCKVSNKALPAPIE KTISKAKGQPREPQVYVLPPSREEMTKNQVSLLCLVKGFYPSDIAVEWESNGQP ENNYLTWPPVLDSDGSFFLYSKLTVDKSRWQQGNVFSCSVMHEALHNHYTQK SLSLSPGK | 602 |
| MHGB668-HL-Fc | QVQLQQSGPGLVKPSQTLSLTCAISGDSVSNNSAAWNWIRQSPSRGLEWLGR TYYRSKWYNDYAVSVKSRITINPDTSKNQFSLQLNSVTPEDTAVYYCARYGSGT LLFDYWGQGTLVTVSSGGSEGKSSGSGSESKSTGGSDIVMTQSPDSLAVSLGER ATINCKSSQSVLYSSKNKNYLAWYQQKPGQPPKLLIYWASTRESGVPDRFSGS GSGTDFTLTISSLQAEDVAVYYCQQYYSTFPYTFGQGTKLEIKEPKSSDKTHTCP PCPAPEAAGGPSVFLFPPKPKDTLMISRTPEVTCVVVSVSHEDPEVKFNWYVD GVEVHNAKTKPREEQYNSTYRVVSVLTVLHQDWLNGKEYKCKVSNKALPAPIE KTISKAKGQPREPQVYVLPPSREEMTKNQVSLLCLVKGFYPSDIAVEWESNGQP ENNYLTWPPVLDSDGSFFLYSKLTVDKSRWQQGNVFSCSVMHEALHNHYTQK SLSLSPGK | 603 |
| MHGB668-LH-Fc | DIVMTQSPDSLAVSLGERATINCKSSQSVLYSSKNKNYLAWYQQKPGQPPKLLI YWASTRESGVPDRFSGSGSGTDFTLTISSLQAEDVAVYYCQQYYSTFPYTFGQG TKLEIKGGSEGKSSGSGSESKSTGGSQVQLQQSGPGLVKPSQTLSLTCAISGDSV SNNSAAWNWIRQSPSRGLEWLGRTYYRSKWYNDYAVSVKSRITINPDTSKNQ FSLQLNSVTPEDTAVYYCARYGSGTLLFDYWGQGTLVTVSSEPKSSDKTHTCPP CPAPEAAGGPSVFLFPPKPKDTLMISRTPEVTCVVVSVSHEDPEVKFNWYVDG VEVHNAKTKPREEQYNSTYRVVSVLTVLHQDWLNGKEYKCKVSNKALPAPIEK TISKAKGQPREPQVYVLPPSREEMTKNQVSLLCLVKGFYPSDIAVEWESNGQPE NNYLTWPPVLDSDGSFFLYSKLTVDKSRWQQGNVFSCSVMHEALHNHYTQKS LSLSPGK | 604 |
| MHGB669-HL-Fc | QVQLQQSGPGLVRPSQTLSVTCAISGDSVSSNSASWNWIRQSPSRGLEWLGR TYYRSEWFNDYAVSVKSRVTINPDTSKNQLSLQLNSVIPEDTAVYYCAREARIGV AGKGFDYWGQGTLVTVSSGGSEGKSSGSGSESKSTGGSDIVMTQSPDSLAVSL GERATINCKSSQSVLFRSNNKNYLAWFQQKPGQPPKLLIYWASTRESGVPDRF SGSGSGTDFTLTISSLQAEDVAVYYCQQYYSTPRTFGQGTKVEIKEPKSSDKTHT CPPCPAPEAAGGPSVFLFPPKPKDTLMISRTPEVTCVVVSVSHEDPEVKFNWYV | 605 |

TABLE 56-continued

Amino acid sequences of the scFv-Fcs.

| Acronym | Amino acid sequence of scFv | SEQ ID NO: |
|---|---|---|
| | DGVEVHNAKTKPREEQYNSTYRVVSVLTVLHQDWLNGKEYKCKVSNKALPAPI<br>EKTISKAKGQPREPQVYVLPPSREEMTKNQVSLLCLVKGFYPSDIAVEWESNGQ<br>PENNYLTWPPVLDSDGSFFLYSKLTVDKSRWQQGNVFSCSVMHEALHNHYTQ<br>KSLSLSPGK | |
| MHGB669-LH-Fc | DIVMTQSPDSLAVSLGERATINCKSSQSVLFRSNNKNYLAWFQQKPGQPPKLLI<br>YWASTRESGVPDRFSGSGSGTDFTLTISSLQAEDVAVYYCQQYYSTPRTFGQGT<br>KVEIKGGSEGKSSGSGSESKSTGGSQVQLQQSGPGLVRPSQTLSVTCAISGDSV<br>SSNSASWNWIRQSPSRGLEWLGRTYYRSEWFNDYAVSVKSRVTINPDTSKNQ<br>LSLQLNSVIPEDTAVYYCAREARIGVAGKGFDYWGQGTLVTVSSEPKSSDKTHT<br>CPPCPAPEAAGGPSVFLFPPKPKDTLMISRTPEVTCVVVSVSHEDPEVKFNWYV<br>DGVEVHNAKTKPREEQYNSTYRVVSVLTVLHQDWLNGKEYKCKVSNKALPAPI<br>EKTISKAKGQPREPQVYVLPPSREEMTKNQVSLLCLVKGFYPSDIAVEWESNGQ<br>PENNYLTWPPVLDSDGSFFLYSKLTVDKSRWQQGNVFSCSVMHEALHNHYTQ<br>KSLSLSPGK | 606 |
| MHGB672-HL-Fc | QVQLQQSGPGLVKPSQTLSLTCAISGDSVSSNRAAWNWIRQTPSRGLEWLGR<br>TYYRSEWYNDYAVSVKSRITINPDTSKNQFSLQLNSVTPEDTAVYYCARVRAAV<br>PFDYWGQGTLVTVSSGGSEGKSSGSGSESKSTGGSDIVMTQSPDSLAVSLGER<br>ATINCKSSQSVLFSSNNKNYLAWYQQKPGQPPNLLIYWASTRESGVPDRFSGS<br>VSGTDFTLTISSLQAEDVAIYYCQQYHSTPWTFGQGTKVEIKEPKSSDKTHTCPP<br>CPAPEAAGGPSVFLFPPKPKDTLMISRTPEVTCVVVSVSHEDPEVKFNWYVDG<br>VEVHNAKTKPREEQYNSTYRVVSVLTVLHQDWLNGKEYKCKVSNKALPAPIEK<br>TISKAKGQPREPQVYVLPPSREEMTKNQVSLLCLVKGFYPSDIAVEWESNGQPE<br>NNYLTWPPVLDSDGSFFLYSKLTVDKSRWQQGNVFSCSVMHEALHNHYTQKS<br>LSLSPGK | 607 |
| MHGB672-LH-Fc | DIVMTQSPDSLAVSLGERATINCKSSQSVLFSSNNKNYLAWYQQKPGQPPNLLI<br>YWASTRESGVPDRFSGSVSGTDFTLTISSLQAEDVAIYYCQQYHSTPWTFGQG<br>TKVEIKGGSEGKSSGSGSESKSTGGSQVQLQQSGPGLVKPSQTLSLTCAISGDSV<br>SSNRAAWNWIRQTPSRGLEWLGRTYYRSEWYNDYAVSVKSRITINPDTSKNQ<br>FSLQLNSVTPEDTAVYYCARVRAAVPFDYWGQGTLVTVSSEPKSSDKTHTCPP<br>CPAPEAAGGPSVFLFPPKPKDTLMISRTPEVTCVVVSVSHEDPEVKFNWYVDG<br>VEVHNAKTKPREEQYNSTYRVVSVLTVLHQDWLNGKEYKCKVSNKALPAPIEK<br>TISKAKGQPREPQVYVLPPSREEMTKNQVSLLCLVKGFYPSDIAVEWESNGQPE<br>NNYLTWPPVLDSDGSFFLYSKLTVDKSRWQQGNVFSCSVMHEALHNHYTQKS<br>LSLSPGK | 608 |
| MHGB687-HL-Fc | QLQLQESGPGLVKPSETLSLMCTVSGGSITSSSYYWGWIRQPPGKGLEWIGNIY<br>YSGTTYYNPSLKSRVTISVDTSKNQFSLKLSSVTAADTAVYYCAAGARDFDSWG<br>QGSLVTVSSGGSEGKSSGSGSESKSTGGSDIVMTQSPDSLAVSLGERATINCKSS<br>QSVLYSSSNKSYLAWYQQRPGQPPKLLIYWASTRESGVPDRFSGSGSGTDFTLT<br>ISSLQAEDVAVYYCQQYYSTPRMYTFGQGTKLEIKEPKSSDKTHTCPPCPAPEA<br>AGGPSVFLFPPKPKDTLMISRTPEVTCVVVSVSHEDPEVKFNWYVDGVEVHNA<br>KTKPREEQYNSTYRVVSVLTVLHQDWLNGKEYKCKVSNKALPAPIEKTISKAKG<br>QPREPQVYVLPPSREEMTKNQVSLLCLVKGFYPSDIAVEWESNGQPENNYLT<br>WPPVLDSDGSFFLYSKLTVDKSRWQQGNVFSCSVMHEALHNHYTQKSLSLSP<br>GK | 609 |
| MHGB687-LH-Fc | DIVMTQSPDSLAVSLGERATINCKSSQSVLYSSSNKSYLAWYQQRPGQPPKLLIY<br>WASTRESGVPDRFSGSGSGTDFTLTISSLQAEDVAVYYCQQYYSTPRMYTFGQ<br>GTKLEIKGGSEGKSSGSGSESKSTGGSQLQLQESGPGLVKPSETLSLMCTVSGGS<br>ITSSSYYWGWIRQPPGKGLEWIGNIYYSGTTYYNPSLKSRVTISVDTSKNQFSLK<br>LSSVTAADTAVYYCAAGARDFDSWGQGSLVTVSSEPKSSDKTHTCPPCPAPEA<br>AGGPSVFLFPPKPKDTLMISRTPEVTCVVVSVSHEDPEVKFNWYVDGVEVHNA<br>KTKPREEQYNSTYRVVSVLTVLHQDWLNGKEYKCKVSNKALPAPIEKTISKAKG<br>QPREPQVYVLPPSREEMTKNQVSLLCLVKGFYPSDIAVEWESNGQPENNYLT<br>WPPVLDSDGSFFLYSKLTVDKSRWQQGNVFSCSVMHEALHNHYTQKSLSLSP<br>GK | 610 |
| MHGB688-HL-Fc | EVQLLESGPGLVKPSQTLSLTCVISGDSVSSNRAAWNWIRQSPSRGLEWLGRT<br>YYRSKWYNDYAVSVKSRITINSDTSKNQISLQLNSVTPEDTAVYYCARVRPGIPF<br>DYWGQGTPVTVSSGGSEGKSSGSGSESKSTGGSDIVMTQSPDSLAVSLGERAT<br>INCKSSQSVLFSSNKKNYLAWYQQKPGQPPKLLIYWASTRESGVPDRFSGSGS<br>GTDFTLTISSLQAEDVAVYYCQQYNSTPWTFGQGTKVEIKEPKSSDKTHTCPPC<br>PAPEAAGGPSVFLFPPKPKDTLMISRTPEVTCVVVSVSHEDPEVKFNWYVDGV<br>EVHNAKTKPREEQYNSTYRVVSVLTVLHQDWLNGKEYKCKVSNKALPAPIEKTI<br>SKAKGQPREPQVYVLPPSREEMTKNQVSLLCLVKGFYPSDIAVEWESNGQPEN<br>NYLTWPPVLDSDGSFFLYSKLTVDKSRWQQGNVFSCSVMHEALHNHYTQKSL<br>SLSPGK | 611 |
| MHGB688-LH-Fc | DIVMTQSPDSLAVSLGERATINCKSSQSVLFSSNKKNYLAWYQQKPGQPPKLLI<br>YWASTRESGVPDRFSGSGSGTDFTLTISSLQAEDVAVYYCQQYNSTPWTFGQG<br>TKVEIKGGSEGKSSGSGSESKSTGGSEVQLLESGPGLVKPSQTLSLTCVISGDSVS | 612 |

TABLE 56-continued

Amino acid sequences of the scFv-Fcs.

| Acronym | Amino acid sequence of scFv | SEQ ID NO: |
|---|---|---|
| | SNRAAWNWIRQSPSRGLEWLGRTYYRSKWYNDYAVSVKSRITINSDTSKNQIS LQLNSVTPEDTAVYYCARVRPGIPFDYWGQGTPVTVSSEPKSSDKTHTCPPCP APEAAGGPSVFLFPPKPKDTLMISRTPEVTCVVVSVSHEDPEVKFNWYVDGVE VHNAKTKPREEQYNSTYRVVSVLTVLHQDWLNGKEYKCKVSNKALPAPIEKTIS KAKGQPREPQVYVLPPSREEMTKNQVSLLCLVKGFYPSDIAVEWESNGQPEN NYLTWPPVLDSDGSFFLYSKLTVDKSRWQQGNVFSCSVMHEALHNHYTQKSL SLSPGK | |
| MHG6689-HL-Fc | QVQLQQSGPGLVKPSQTLSLTCVISGDSVSSNRAAWNWIRQSPSRGLEWLGR TYYRSKWYNDYAVSVKSRITINSDTSKNQISLQLNSVTPEDTAVYYCARVRPGIP FDYWGQGTTVTVSSGGSEGKSSGSGSESKSTGGSDIQMTQSPDSLAVSLGERA TINCESSQSVLFSSNKKNYLAWYQQKPGQPPKLLIYWASTRESGVPDRFSGSGS GTDFTLTINRLQAEDVAVYYCQQYNSTPWTFGQGTKVEIKEPKSSDKTHTCPPC PAPEAAGGPSVFLFPPKPKDTLMISRTPEVTCVVVSVSHEDPEVKFNWYVDGV EVHNAKTKPREEQYNSTYRVVSVLTVLHQDWLNGKEYKCKVSNKALPAPIEKTI SKAKGQPREPQVYVLPPSREEMTKNQVSLLCLVKGFYPSDIAVEWESNGQPEN NYLTWPPVLDSDGSFFLYSKLTVDKSRWQQGNVFSCSVMHEALHNHYTQKSL SLSPGK | 613 |
| MHGB689-LH-Fc | DIQMTQSPDSLAVSLGERATINCESSQSVLFSSNKKNYLAWYQQKPGQPPKLLI YWASTRESGVPDRFSGSGSGTDFTLTINRLQAEDVAVYYCQQYNSTPWTFGQ GTKVEIKGGSEGKSSGSGSESKSTGGSQVQLQQSGPGLVKPSQTLSLTCVISGD SVSSNRAAWNWIRQSPSRGLEWLGRTYYRSKWYNDYAVSVKSRITINSDTSKN QISLQLNSVTPEDTAVYYCARVRPGIPFDYWGQGTTVTVSSEPKSSDKTHTCPP CPAPEAAGGPSVFLFPPKPKDTLMISRTPEVTCVVVSVSHEDPEVKFNWYVDG VEVHNAKTKPREEQYNSTYRVVSVLTVLHQDWLNGKEYKCKVSNKALPAPIEK TISKAKGQPREPQVYVLPPSREEMTKNQVSLLCLVKGFYPSDIAVEWESNGQPE NNYLTWPPVLDSDGSFFLYSKLTVDKSRWQQGNVFSCSVMHEALHNHYTQKS LSLSPGK | 614 |
| MHGB694-HL-Fc | EVQLLESGGGLVQPGGSLRLSCAASGFTFSSYAMHWVRQAPGKGLDWVSGIS GSGFSTYYVDSVKGRFTISRDNSKHTLYLQMNSLRAEDTAVYYCAKDNLVAGT VFDYWGQGTLVTVSSGGSEGKSSGSGSESKSTGGSDIQMTQSPSTLSASVGDR VTITCRASQSISSWLAWYQQKPGKAPKLLIYKASSLESGVPSRFSGSGSGTEFTLT ISSLQPDDFATYYCQQYNSYSLTFGGGTKVDIKEPKSSDKTHTCPPCPAPEAAG GPSVFLFPPKPKDTLMISRTPEVTCVVVSVSHEDPEVKFNWYVDGVEVHNAKT KPREEQYNSTYRVVSVLTVLHQDWLNGKEYKCKVSNKALPAPIEKTISKAKGQP REPQVYVLPPSREEMTKNQVSLLCLVKGFYPSDIAVEWESNGQPENNYLTWPP VLDSDGSFFLYSKLTVDKSRWQQGNVFSCSVMHEALHNHYTQKSLSLSPGK | 615 |
| MHGB694-LH-Fc | DIQMTQSPSTLSASVGDRVTITCRASQSISSWLAWYQQKPGKAPKLLIYKASSL ESGVPSRFSGSGSGTEFTLTISSLQPDDFATYYCQQYNSYSLTFGGGTKVDIKGG SEGKSSGSGSESKSTGGSEVQLLESGGGLVQPGGSLRLSCAASGFTFSSYAMH WVRQAPGKGLDWVSGISGSGFSTYYVDSVKGRFTISRDNSKHTLYLQMNSLR AEDTAVYYCAKDNLVAGTVFDYWGQGTLVTVSSEPKSSDKTHTCPPCPAPEAA GGPSVFLFPPKPKDTLMISRTPEVTCVVVSVSHEDPEVKFNWYVDGVEVHNAK TKPREEQYNSTYRVVSVLTVLHQDWLNGKEYKCKVSNKALPAPIEKTISKAKGQ PREPQVYVLPPSREEMTKNQVSLLCLVKGFYPSDIAVEWESNGQPENNYLTWP PVLDSDGSFFLYSKLTVDKSRWQQGNVFSCSVMHEALHNHYTQKSLSLSPGK | 616 |
| MHGB732-HL-Fc | QVQLQQSGPGLVKPSQTLSLTCAISGDSVSSNSAAWNWIRQSPSRGLEWLGR TYYRSKWYNDYAVSVKSRITINPDTSKNQISLQLNSVTPEDTAVYYCAGDRRYGI VGLPFAYWGQGTLVTVSSGGSEGKSSGSGSESKSTGGSDIVMTQSPDSLAVSL GERATINCKSSQSVLHSSNNKNYLTWFQQKPGQPPKLLIYWASTRESGVPDRF SGSGSGTDFTLTISSLQAEDVAVYYCHQYYSTPPTFGQGTKVEIKEPKSSDKTHT CPPCPAPEAAGGPSVFLFPPKPKDTLMISRTPEVTCVVVSVSHEDPEVKFNWYV DGVEVHNAKTKPREEQYNSTYRVVSVLTVLHQDWLNGKEYKCKVSNKALPAPI EKTISKAKGQPREPQVYVLPPSREEMTKNQVSLLCLVKGFYPSDIAVEWESNGQ PENNYLTWPPVLDSDGSFFLYSKLTVDKSRWQQGNVFSCSVMHEALHNHYTQ KSLSLSPGK | 617 |
| MHGB732-LH-Fc | DIVMTQSPDSLAVSLGERATINCKSSQSVLHSSNNKNYLTWFQQKPGQPPKLLI YWASTRESGVPDRFSGSGSGTDFTLTISSLQAEDVAVYYCHQYYSTPPTFGQGT KVEIKGGSEGKSSGSGSESKSTGGSQVQLQQSGPGLVKPSQTLSLTCAISGDSVS SNSAAWNWIRQSPSRGLEWLGRTYYRSKWYNDYAVSVKSRITINPDTSKNQIS LQLNSVTPEDTAVYYCAGDRRYGIVGLPFAYWGQGTLVTVSSEPKSSDKTHTCP PCPAPEAAGGPSVFLFPPKPKDTLMISRTPEVTCVVVSVSHEDPEVKFNWYVD GVEVHNAKTKPREEQYNSTYRVVSVLTVLHQDWLNGKEYKCKVSNKALPAPIE KTISKAKGQPREPQVYVLPPSREEMTKNQVSLLCLVKGFYPSDIAVEWESNGQP ENNYLTWPPVLDSDGSFFLYSKLTVDKSRWQQGNVFSCSVMHEALHNHYTQK SLSLSPGK | 618 |
| MHGB737-HL-Fc | EVQLLESGGGLVQPGGSLRLSCAASGFTFSSYAMHWVRQAPGKGLEWVSGIS GSGFSTYYVDSVKGRFTISRDNSKNTLYLQMNSLRAEDTAVYYCAKDNLVAGT | 619 |

TABLE 56-continued

Amino acid sequences of the scFv-Fcs.

| Acronym | Amino acid sequence of scFv | SEQ ID NO: |
|---|---|---|
| | VFDYWGQGTLVTVSSGGSEGKSSGSGSESKSTGGSDIQMTQSPSTLSASVGDR VTITCRASQSISSWLAWYQQKPGKAPKLLIYKASSLESGVPSRFSGSGSGTEFTLT ISSLQPDDFATYYCQQYNSYSLTFGGGTKVDIKEPKSSDKTHTCPPCPAPEAAG GPSVFLFPPKPKDTLMISRTPEVTCVVVSVSHEDPEVKFNWYVDGVEVHNAKT KPREEQYNSTYRVVSVLTVLHQDWLNGKEYKCKVSNKALPAPIEKTISKAKGQP REPQVYVLPPSREEMTKNQVSLLCLVKGFYPSDIAVEWESNGQPENNYLTWPP VLDSDGSFFLYSKLTVDKSRWQQGNVFSCSVMHEALHNHYTQKSLSLSPGK | |
| MHGB737-LH-Fc | DIQMTQSPSTLSASVGDRVTITCRASQSISSWLAWYQQKPGKAPKLLIYKASSL ESGVPSRFSGSGSGTEFTLTISSLQPDDFATYYCQQYNSYSLTFGGGTKVDIKGG SEGKSSGSGSESKSTGGSEVQLLESGGGLVQPGGSLRLSCAASGFTFSSYAMH WVRQAPGKGLEWVSGISGSGFSTYYVDSVKGRFTISRDNSKNTLYLQMNSLRA EDTAVYYCAKDNLVAGTVFDYWGQGTLVTVSSEPKSSDKTHTCPPCPAPEAAG GPSVFLFPPKPKDTLMISRTPEVTCVVVSVSHEDPEVKFNWYVDGVEVHNAKT KPREEQYNSTYRVVSVLTVLHQDWLNGKEYKCKVSNKALPAPIEKTISKAKGQP REPQVYVLPPSREEMTKNQVSLLCLVKGFYPSDIAVEWESNGQPENNYLTWPP VLDSDGSFFLYSKLTVDKSRWQQGNVFSCSVMHEALHNHYTQKSLSLSPGK | 620 |
| MHGB738-HL-Fc | QVQLQQSGPGLVKPSQTLSLTCAISGDSVSSNRAAWNWIRQSPSRGLEWLGR TYYRSKWYNDYAVSVKSRITINPDTSKNQISLQLNSVTPEDTAVYYCARVRPGIP FDYWGQGTPVTVSSGGSEGKSSGSGSESKSTGGSDIVMTQSPDSLAVSLGERA TINCKSSQSVLFSSNNKNYLAWYQQKPGQPPKLLIYWASTRESGVPDRFSGSVS GTDFTLTISSLQAEDVAVYYCQQYHSTPWTFGQGTKVEIKEPKSSDKTHTCPPC PAPEAAGGPSVFLFPPKPKDTLMISRTPEVTCVVVSVSHEDPEVKFNWYVDGV EVHNAKTKPREEQYNSTYRVVSVLTVLHQDWLNGKEYKCKVSNKALPAPIEKTI SKAKGQPREPQVYVLPPSREEMTKNQVSLLCLVKGFYPSDIAVEWESNGQPEN NYLTWPPVLDSDGSFFLYSKLTVDKSRWQQGNVFSCSVMHEALHNHYTQKSL SLSPGK | 621 |
| MHGB738-LH-Fc | DIVMTQSPDSLAVSLGERATINCKSSQSVLFSSNNKNYLAWYQQKPGQPPKLLI YWASTRESGVPDRFSGSVSGTDFTLTISSLQAEDVAVYYCQQYHSTPWTFGQG TKVEIKGGSEGKSSGSGSESKSTGGSQVQLQQSGPGLVKPSQTLSLTCAISGDSV SSNRAAWNWIRQSPSRGLEWLGRTYYRSKWYNDYAVSVKSRITINPDTSKNQI SLQLNSVTPEDTAVYYCARVRPGIPFDYWGQGTPVTVSSEPKSSDKTHTCPPCP APEAAGGPSVFLFPPKPKDTLMISRTPEVTCVVVSVSHEDPEVKFNWYVDGVE VHNAKTKPREEQYNSTYRVVSVLTVLHQDWLNGKEYKCKVSNKALPAPIEKTIS KAKGQPREPQVYVLPPSREEMTKNQVSLLCLVKGFYPSDIAVEWESNGQPEN NYLTWPPVLDSDGSFFLYSKLTVDKSRWQQGNVFSCSVMHEALHNHYTQKSL SLSPGK | 622 |

TABLE 57 cDNA sequences of anti-HLA-G scFvs and scFv-Fcs.

| scFv or scFv-Fc | cDNA SEQ ID NO: | cDNA |
|---|---|---|
| MHG B665-HL | 623 | CAGGTGCAGCTGCAGCAGAGCGGCCCTGGACTGGTGAAGCCCAGCCA GACCCTGAGCCTGACCTGCGCTATCAGCGGCGATAGCGTGAGCTCCAA CAGCGCCGCCTGGAACTGGATCAGGCAGAGCCCTAGCAGGGGCCTGG AATGGCTGGGCAGGACCTACTACAGGAGCAAGTGGTACAACGACTAC GCCGTGTCCGTGAAGAGCAGGATCACCATCAACCCCGACACCAGCAA GAACCAGATCAGCCTGCAGCTGAACAGCGTGACCCCCGAGGACACCG CCGTGTACTACTGCGCCGGCGACAGAAGGTACGGCATCGTGGGCCTG CCTTTCGCCTACTGGGGCCAGGGAACCCTGGTGACCGTGAGCAGCGGC GGATCTGAGGGAAAGTCCAGCGGCTCCGGCAGCGAAAGCAAGTCCAC CGGCGGAAGCGACATCGTGATGACCCAGAGCCCCGATAGCCTGGCTG TGAGCCTGGGCGAGAGAGCCACCATCAACTGCAAGAGCAGCCAGAGC GTGCTGCACAGCAGCAACAACAAGAACTACCTGACCTGGTTCCAGCA GAAGCCCGGCCAGCCTCCCAAGCTGCTGATCTACTGGGCTAGCACCAG AGAGTCCGGCGTGCCTGACAGGTTCAGCGGAAGCGGCAGCGGCACCG ACTTCACCCTGACCATCAGCAGCCTGCAGGCCGAGGACGTGGCCGTGT ACTACTGCCACCAGTACTACAGCACCCCCCCCTACCTTTGGCCAGGGCA CCAAGGTGGAGATCAAG |
| MHG B665-LH | 624 | GACATCGTGATGACCCAGAGCCCCGATAGCCTGGCTGTGAGCCTGGG CGAGAGAGCCACCATCAACTGCAAGAGCAGCCAGAGCGTGCTGCACA GCAGCAACAACAAGAACTACCTGACCTGGTTCCAGCAGAAGCCCGGC CAGCCTCCCAAGCTGCTGATCTACTGGGCTAGCACCAGAGAGTCCGGC |

TABLE 57-continued

| cDNA sequences of anti-HLA-G scFvs and scFv-Fcs. | | |
|---|---|---|
| scFv or scFv-Fc | cDNA SEQ ID NO: | cDNA |
| | | GTGCCTGACAGGTTCAGCGGAAGCGGCAGCGGCACCGACTTCACCCT GACCATCAGCAGCCTGCAGGCCGAGGACGTGGCCGTGTACTACTGCC ACCAGTACTACAGCACCCCCCCTACCTTTGGCCAGGGCACCAAGGTGG AGATCAAGGGCGGATCTGAGGGAAAGTCCAGCGGCTCCGGCAGCGAA AGCAAGTCCACCGGCGGAAGCCAGGTGCAGCTGCAGCAGAGCGGCCC TGGACTGGTGAAGCCCAGCCAGACCCTGAGCCTGACCTGCGCTATCAG CGGCGATAGCGTGAGCTCCAACAGCGCCGCCTGGAACTGGATCAGGC AGAGCCCTAGCAGGGGCCTGGAATGGCTGGGCAGGACCTACTACAGG AGCAAGTGGTACAACGACTACGCCGTGTCCGTGAAGAGCAGGATCAC CATCAACCCCGACACCAGCAAGAACCAGATCAGCCTGCAGCTGAACA GCGTGACCCCCGAGGACACCGCCGTGTACTACTGCGCCGGCGACAGA AGGTACGGCATCGTGGGCCTGCCTTTCGCCTACTGGGGCCAGGGAACC CTGGTGACCGTGAGCAGC |
| MHG B668-HL | 625 | CAGGTGCAGCTGCAGCAGAGCGGACCCGGCCTGGTGAAACCCAGCCA GACCCTGAGCCTGACCTGCGCCATCAGCGGCGACAGCGTGAGCAACA ACAGCGCCGCCTGGAACTGGATCAGGCAGAGCCCCAGCAGAGGCCTG GAATGGCTGGGCAGGACCTACTACAGGAGCAAGTGGTACAACGACTA CGCCGTGAGCGTGAAGAGCAGGATCACCATCAACCCCGACACCTCCA AGAACCAGTTCAGCCTGCAGCTGAACAGCGTGACCCCCGAGGACACC GCCGTGTACTACTGCGCCAGGTATGGCAGCGGCACCCTGCTGTTCGAC TACTGGGGCCAGGGCACCCTGGTGACAGTGAGCAGCGGCGGATCTGA GGGAAAGTCCAGCGGCTCCGGCAGCGAAAGCAAGTCCACCGGCGGAA GCGACATCGTGATGACCCAGAGCCCCGATAGCCTGGCTGTGAGCCTG GGAGAGAGGGCCACCATCAACTGCAAGAGCAGCCAGAGCGTGCTGTA CAGCAGCAAGAACAAGAACTACCTGGCCTGGTACCAGCAGAAACCCG GCCAGCCCCCCAAGCTGCTGATCTACTGGGCCAGCACAAGGGAAAGC GGCGTGCCCGACAGATTCAGCGGAAGCGGCAGCGGCACCGACTTCAC CCTGACCATCAGCAGCCTGCAGGCCGAGGATGTGGCCGTGTACTACTG CCAGCAGTACTACAGCACCTTCCCCTACACCTTCGGCCAGGGCACCAA GCTGGAGATCAAG |
| MHG B668-LH | 626 | GACATCGTGATGACCCAGAGCCCCGATAGCCTGGCTGTGAGCCTGGG AGAGAGGGCCACCATCAACTGCAAGAGCAGCCAGAGCGTGCTGTACA GCAGCAAGAACAAGAACTACCTGGCCTGGTACCAGCAGAAACCCGGC CAGCCCCCCAAGCTGCTGATCTACTGGGCCAGCACAAGGGAAAGCGG CGTGCCCGACAGATTCAGCGGAAGCGGCAGCGGCACCGACTTCACCC TGACCATCAGCAGCCTGCAGGCCGAGGATGTGGCCGTGTACTACTGCC AGCAGTACTACAGCACCTTCCCCTACACCTTCGGCCAGGGCACCAAGC TGGAGATCAAGGGCGGATCTGAGGGAAAGTCCAGCGGCTCCGGCAGC GAAAGCAAGTCCACCGGCGGAAGCCAGGTGCAGCTGCAGCAGAGCGG ACCCGGCCTGGTGAAACCCAGCCAGACCCTGAGCCTGACCTGCGCCAT CAGCGGCGACAGCGTGAGCAACAACAGCGCCGCCTGGAACTGGATCA GGCAGAGCCCCAGCAGAGGCCTGGAATGGCTGGGCAGGACCTACTAC AGGAGCAAGTGGTACAACGACTACGCCGTGAGCGTGAAGAGCAGGAT CACCATCAACCCCGACACCTCCAAGAACCAGTTCAGCCTGCAGCTGAA CAGCGTGACCCCCGAGGACACCGCCGTGTACTACTGCGCCAGGTATG GCAGCGGCACCCTGCTGTTCGACTACTGGGGCCAGGGCACCCTGGTGA CAGTGAGCAGC |
| MHG B669-HL | 627 | CAGGTGCAGCTGCAGCAGAGCGGACCCGGACTGGTGAGACCCAGCCA GACCCTGAGCGTGACCTGCGCCATCAGCGGCGACAGCGTGAGCAGCA ACAGCGCCAGCTGGAACTGGATCAGGCAGAGCCCCAGCAGAGGCCTG GAGTGGCTGGGAAGGACATACTACAGGAGCGAGTGGTTCAACGACTA CGCCGTGAGCGTGAAGAGCAGGGTGACCATCAACCCCGACACCAGCA AGAACCAGCTGAGCCTGCAGCTGAACAGCGTGATCCCCGAGGACACC GCCGTGTACTACTGCGCCAGAGAGGCCAGAATCGGCGTGGCCGGCAA AGGCTTCGACTACTGGGGCCAGGGCACCCTGGTGACAGTGTCCAGCG GCGGATCTGAGGGAAAGTCCAGCGGCTCCGGCAGCGAAAGCAAGTCC ACCGGCGGAAGCGACATCGTGATGACCCAGAGCCCTGACTCCCTGGC TGTGAGCCTGGGCGAGAGAGCCACCATCAACTGCAAGAGCAGCCAGA GCGTGCTGTTCAGGAGCAACAACAAGAACTACCTGGCCTGGTTCCAGC AGAAGCCCGGCCAGCCTCCCAAGCTGCTGATCTACTGGGCCAGCACC AGAGAGAGCGGCGTGCCCGATAGATTTAGCGGCAGCGGCAGCGGCAC CGACTTTACCCTGACCATCAGCTCCCTGCAGGCCGAGGATGTGGCCGT GTACTACTGCCAGCAGTACTACAGCACCCCCAGAACCTTCGGCCAGGG CACCAAGGTGGAGATCAAG |
| MHG B669-LH | 628 | GACATCGTGATGACCCAGAGCCCTGACTCCCTGGCTGTGAGCCTGGGC GAGAGAGCCACCATCAACTGCAAGAGCAGCCAGAGCGTGCTGTTCAG GAGCAACAACAAGAACTACCTGGCCTGGTTCCAGCAGAAGCCCGGCC AGCCTCCCAAGCTGCTGATCTACTGGGCCAGCACCAGAGAGAGCGGC GTGCCCGATAGATTTAGCGGCAGCGGCAGCGGCACCGACTTTACCCTG |

TABLE 57-continued

| scFv or scFv-Fc | cDNA SEQ ID NO: | cDNA |
|---|---|---|
| cDNA sequences of anti-HLA-G scFvs and scFv-Fcs. | | |
| | | ACCATCAGCTCCCTGCAGGCCGAGGATGTGGCCGTGTACTACTGCCAG<br>CAGTACTACAGCACCCCCAGAACCTTCGGCCAGGGCACCAAGGTGGA<br>GATCAAGGGCGGATCTGAGGGAAAGTCCAGCGGCTCCGGCAGCGAAA<br>GCAAGTCCACCGGCGGAAGCCAGGTGCAGCTGCAGCAGAGCGGACCC<br>GGACTGGTGAGACCCAGCCAGACCCTGAGCGTGACCTGCGCCATCAG<br>CGGCGACAGCGTGAGCAGCAACAGCGCCAGCTGGAACTGGATCAGGC<br>AGAGCCCCAGCAGAGGCCTGGAGTGGCTGGGAAGGACATACTACAGG<br>AGCGAGTGGTTCAACGACTACGCCGTGAGCGTGAAGAGCAGGGTGAC<br>CATCAACCCCGACACCAGCAAGAACCAGCTGAGCCTGCAGCTGAACA<br>GCGTGATCCCCGAGGACACCGCCGTGTACTACTGCGCCAGAGAGGCC<br>AGAATCGGCGTGGCCGGCAAAGGCTTCGACTACTGGGGCCAGGGCAC<br>CCTGGTGACAGTGTCCAGC |
| MHG B672-HL | 629 | CAGGTGCAGCTGCAGCAGAGCGGACCTGGCCTGGTGAAGCCCAGCCA<br>GACCCTGAGCCTGACATGCGCCATCAGCGGCGACAGCGTGAGCAGCA<br>ATAGGGCCGCCTGGAACTGGATCAGGCAGACCCCTAGCAGGGGCCTG<br>GAATGGCTGGGCAGGACATACTACAGGAGCGAGTGGTACAACGACTA<br>CGCCGTGTCCGTGAAGAGCAGGATCACCATCAACCCCGACACCAGCA<br>AGAACCAGTTCAGCCTGCAGCTGAACAGCGTGACCCCCGAGGACACC<br>GCCGTGTACTACTGCGCCAGAGTGAGAGCCGCCGTGCCTTTCGACTAC<br>TGGGGCCAGGGCACCCTGGTGACAGTGAGCAGCGGCGGATCTGAGGG<br>AAAGTCCAGCGGCTCCGGCAGCGAAAGCAAGTCCACCGGCGGAAGCG<br>ACATCGTGATGACCCAGAGCCCCGATAGCCTGGCTGTGAGCCTGGGC<br>GAGAGGGCCACCATCAACTGCAAGAGCAGCCAGAGCGTGCTGTTTTC<br>CAGCAACAACAAGAACTACCTGGCCTGGTACCAGCAGAAACCCGGCC<br>AGCCCCCCAACCTGCTGATCTACTGGGCCAGCACCAGAGAAAGCGGC<br>GTGCCCGACAGGTTTAGCGGCAGCGTGAGCGGCACCGACTTCACCCTG<br>ACCATCAGCAGCCTGCAGGCCGAGGACGTGGCCATCTACTACTGCCA<br>GCAGTACCACAGCACCCCCTGGACATTCGGCCAGGGCACCAAGGTGG<br>AGATCAAG |
| MHG B672-LH | 630 | GACATCGTGATGACCCAGAGCCCCGATAGCCTGGCTGTGAGCCTGGG<br>CGAGAGGGCCACCATCAACTGCAAGAGCAGCCAGAGCGTGCTGTTTT<br>CCAGCAACAACAAGAACTACCTGGCCTGGTACCAGCAGAAACCCGGC<br>CAGCCCCCCAACCTGCTGATCTACTGGGCCAGCACCAGAGAAAGCGG<br>CGTGCCCGACAGGTTTAGCGGCAGCGTGAGCGGCACCGACTTCACCCT<br>GACCATCAGCAGCCTGCAGGCCGAGGACGTGGCCATCTACTACTGCC<br>AGCAGTACCACAGCACCCCCTGGACATTCGGCCAGGGCACCAAGGTG<br>GAGATCAAGGGCGGATCTGAGGGAAAGTCCAGCGGCTCCGGCAGCGA<br>AAGCAAGTCCACCGGCGGAAGCCAGGTGCAGCTGCAGCAGAGCGGAC<br>CTGGCCTGGTGAAGCCCAGCCAGACCCTGAGCCTGACATGCGCCATCA<br>GCGGCGACAGCGTGAGCAGCAATAGGGCCGCCTGGAACTGGATCAGG<br>CAGACCCCTAGCAGGGGCCTGGAATGGCTGGGCAGGACATACTACAG<br>GAGCGAGTGGTACAACGACTACGCCGTGTCCGTGAAGAGCAGGATCA<br>CCATCAACCCCGACACCAGCAAGAACCAGTTCAGCCTGCAGCTGAAC<br>AGCGTGACCCCCGAGGACACCGCCGTGTACTACTGCGCCAGAGTGAG<br>AGCCGCCGTGCCTTTCGACTACTGGGGCCAGGGCACCCTGGTGACAGT<br>GAGCAGC |
| MHG B687-HL | 631 | CAGCTGCAGCTGCAGGAGAGCGGCCCTGGACTGGTGAAGCCCAGCGA<br>GACCCTGAGCCTGATGTGCACCGTGAGCGGCGGCAGCATCACCAGCA<br>GCAGCTACTACTGGGGATGGATCAGACAGCCCCCTGGCAAGGGCCTG<br>GAGTGGATCGGCAACATCTACTACAGCGGCACCACCTACTACAACCCC<br>AGCCTGAAGAGCAGGGTGACCATCAGCGTGGACACCAGCAAGAACCA<br>GTTCAGCCTGAAGCTGAGCAGCGTGACAGCTGCCGACACCGCCGTGT<br>ACTACTGTGCCGCCGGAGCCAGAGACTTCGACAGCTGGGGACAGGGC<br>AGCCTGGTGACCGTGTCCAGCGGCGGATCTGAGGGAAAGTCCAGCGG<br>CTCCGGCAGCGAAAGCAAGTCCACCGGCGGAAGCGACATCGTGATGA<br>CCCAGAGCCCTGATAGCCTGGCCGTGAGCCTGGGAGAGAGAGCCACC<br>ATCAACTGCAAGTCCTCCCAGAGCGTGCTGTACAGCTCCAGCAACAAG<br>AGCTACCTGGCCTGGTACCAGCAGAGGCCCGGACAGCCTCCCAAGCT<br>GCTGATCTACTGGGCCAGCACCAGAGAGAGCGGCGTGCCTGACAGGT<br>TTAGCGGCTCCGGCTCCGGCACCGACTTTACCCTGACCATCAGCAGCC<br>TGCAGGCCGAGGATGTGGCCGTGTACTACTGCCAGCAGTACTACAGC<br>ACCCCCAGGATGTACACCTTCGGCCAGGGCACCAAGCTGGAGATCAA<br>G |
| MHG B687-LH | 632 | GACATCGTGATGACCCAGAGCCCTGATAGCCTGGCCGTGAGCCTGGG<br>AGAGAGAGCCACCATCAACTGCAAGTCCTCCCAGAGCGTGCTGTACA<br>GCTCCAGCAACAAGAGCTACCTGGCCTGGTACCAGCAGAGGCCCGGA<br>CAGCCTCCCAAGCTGCTGATCTACTGGGCCAGCACCAGAGAGAGCGG<br>CGTGCCTGACAGGTTTAGCGGCTCCGGCTCCGGCACCGACTTTACCCT<br>GACCATCAGCAGCCTGCAGGCCGAGGATGTGGCCGTGTACTACTGCC |

TABLE 57-continued cDNA sequences of anti-HLA-G scFvs and scFv-Fcs.

| scFv or scFv-Fc | cDNA SEQ ID NO: | cDNA |
|---|---|---|
| | | AGCAGTACTACAGCACCCCCAGGATGTACACCTTCGGCCAGGGCACC AAGCTGGAGATCAAGGGCGGATCTGAGGGAAAGTCCAGCGGCTCCGG CAGCGAAAGCAAGTCCACCGGCGGAAGCCAGCTGCAGCTGCAGGAGA GCGGCCCTGGACTGGTGAAGCCCAGCGAGACCCTGAGCCTGATGTGC ACCGTGAGCGGCGGCAGCATCACCAGCAGCAGCTACTACTGGGGATG GATCAGACAGCCCCCTGGCAAGGGCCTGGAGTGGATCGGCAACATCT ACTACAGCGGCACCACCTACTACAACCCCAGCCTGAAGAGCAGGGTG ACCATCAGCGTGGACACCAGCAAGAACCAGTTCAGCCTGAAGCTGAG CAGCGTGACAGCTGCCGACACCGCCGTGTACTACTGTGCCGCCGGAGC CAGAGACTTCGACAGCTGGGGACAGGGCAGCCTGGTGACCGTGTCCA GC |
| MHG B688-HL | 633 | GAGGTGCAGCTGTTGGAGTCAGGTCCAGGACTGGTGAAGCCCTCGCA GACCCTCTCACTCACCTGTGTCATCTCCGGGGACAGTGTCTCTAGCAA CAGAGCTGCTTGGAACTGGATCAGGCAGTCCCCATCGAGAGGCCTTG AGTGGCTGGGAAGGACATACTACAGGTCCAAGTGGTATAATGATTAT GCAGTATCTGTGAAAAGTCGAATAACCATCAATTCAGACACATCCAA GAACCAGATCTCCCTGCAGTTGAACTCTGTGACTCCCGAGGACACGGC TGTGTATTACTGTGCAAGAGTGAGACCGGGGATCCCATTTGACTACTG GGGCCAGGGAACCCCGGTCACCGTCTCCTCAGGCGGATCTGAGGGAA AGTCCAGCGGCTCCGGCAGCGAAAGCAAGTCCACCGGCGGAAGCGAC ATCGTGATGACCCAGTCTCCAGACTCCCTGGCTGTGTCTCTGGGCGAG AGGGCCACCATCAACTGCAAGTCCAGCCAGAGTGTTTTATTCAGCTCC AACAAAAAGAACTACTTAGCTTGGTACCAGCAGAAACCAGGACAGCC CCCTAAGCTGCTCATTTACTGGGCATCTACCCGGGAATCCGGGGTCCC TGACCGATTCAGTGGCAGCGGGTCTGGGACAGATTTCACTCTCACCAT CAGCAGCCTGCAGGCTGAAGATGTGGCAGTTTATTACTGTCAGCAATA TAATAGTACTCCGTGGACGTTCGGCCAAGGGACCAAGGTGGAGATCA AA |
| MHG B688-LH | 634 | GACATCGTGATGACCCAGTCTCCAGACTCCCTGGCTGTGTCTCTGGGC GAGAGGGCCACCATCAACTGCAAGTCCAGCCAGAGTGTTTTATTCAGC TCCAACAAAAAGAACTACTTAGCTTGGTACCAGCAGAAACCAGGACA GCCCCCTAAGCTGCTCATTTACTGGGCATCTACCCGGGAATCCGGGGT CCCTGACCGATTCAGTGGCAGCGGGTCTGGGACAGATTTCACTCTCAC CATCAGCAGCCTGCAGGCTGAAGATGTGGCAGTTTATTACTGTCAGCA ATATAATAGTACTCCGTGGACGTTCGGCCAAGGGACCAAGGTGGAGA TCAAAGGCGGATCTGAGGGAAAGTCCAGCGGCTCCGGCAGCGAAAGC AAGTCCACCGGCGGAAGCGAGGTGCAGCTGTTGGAGTCAGGTCCAGG ACTGGTGAAGCCCTCGCAGACCCTCTCACTCACCTGTGTCATCTCCGG GGACAGTGTCTCTAGCAACAGAGCTGCTTGGAACTGGATCAGGCAGT CCCCATCGAGAGGCCTTGAGTGGCTGGGAAGGACATACTACAGGTCC AAGTGGTATAATGATTATGCAGTATCTGTGAAAAGTCGAATAACCATC AATTCAGACACATCCAAGAACCAGATCTCCCTGCAGTTGAACTCTGTG ACTCCCGAGGACACGGCTGTGTATTACTGTGCAAGAGTGAGACCGGG GATCCCATTTGACTACTGGGGCCAGGGAACCCCGGTCACCGTCTCCTC A |
| MHG B689-HL | 635 | CAGGTACAGCTGCAGCAGTCAGGTCCAGGACTGGTGAAGCCCTCGCA GACCCTCTCACTCACCTGTGTCATCTCCGGGGACAGTGTCTCTAGCAA CAGAGCTGCCTGGAACTGGATCAGGCAGTCCCCATCGAGAGGCCTTG AGTGGCTGGGAAGGACATACTACAGGTCCAAGTGGTATAATGATTAT GCAGTTTCTGTGAAAAGTCGAATAACCATCAATTCAGACACATCCAAG AACCAGATCTCCCTGCAGTTGAACTCTGTGACTCCCGAGGACACGGCT GTGTATTACTGTGCAAGAGTGAGACCGGGGATCCCTTTTGACTACTGG GGCCAGGGAACCACGGTCACCGTCTCCTCAGGCGGATCTGAGGGAAA GTCCAGCGGCTCCGGCAGCGAAAGCAAGTCCACCGGCGGAAGCGACA TCCAGATGACCCAGTCTCCAGACTCCCTGGCTGTGTCTCTGGGCGAGA GGGCCACCATCAACTGCGAGTCCAGCCAGAGTGTTTTATTCAGCTCCA ACAAAAAGAACTACTTAGCTTGGTACCAGCAGAAACCAGGACAGCCC CCTAAGCTGCTCATTTACTGGGCATCTACCCGGGAATCCGGGGTCCCT GACCGATTCAGTGGCAGCGGGTCTGGGACAGATTTCACTCTCACCATC AACCGCCTGCAGGCTGAAGATGTGGCAGTTTATTACTGTCAGCAATAT AATAGTACTCCGTGGACGTTCGGCCAAGGGACCAAGGTGGAGATCAA A |
| MHG B689-LH | 636 | GACATCCAGATGACCCAGTCTCCAGACTCCCTGGCTGTGTCTCTGGGC GAGAGGGCCACCATCAACTGCGAGTCCAGCCAGAGTGTTTTATTCAGC TCCAACAAAAAGAACTACTTAGCTTGGTACCAGCAGAAACCAGGACA GCCCCCTAAGCTGCTCATTTACTGGGCATCTACCCGGGAATCCGGGGT CCCTGACCGATTCAGTGGCAGCGGGTCTGGGACAGATTTCACTCTCAC CATCAACCGCCTGCAGGCTGAAGATGTGGCAGTTTATTACTGTCAGCA ATATAATAGTACTCCGTGGACGTTCGGCCAAGGGACCAAGGTGGAGA |

TABLE 57-continued cDNA sequences of anti-HLA-G scFvs and scFv-Fcs.

| scFv or scFv-Fc | cDNA SEQ ID NO: | cDNA |
|---|---|---|
| | | TCAAAGGCGGATCTGAGGGAAAGTCCAGCGGCTCCGGCAGCGAAAGC AAGTCCACCGGCGGAAGCCAGGTACAGCTGCAGCAGTCAGGTCCAGG ACTGGTGAAGCCCTCGCAGACCCTCTCACTCACCTGTGTCATCTCCGG GGACAGTGTCTCTAGCAACAGAGCTGCCTGGAACTGGATCAGGCAGT CCCCATCGAGAGGCCTTGAGTGGCTGGGAAGGACATACTACAGGTCC AAGTGGTATAATGATTATGCAGTTTCTGTGAAAAGTCGAATAACCATC AATTCAGACACATCCAAGAACCAGATCTCCCTGCAGTTGAACTCTGTG ACTCCCGAGGACACGGCTGTGTATTACTGTGCAAGAGTGAGACCGGG GATCCCTTTTGACTACTGGGGCCAGGGAACCACGGTCACCGTCTCCTC A |
| MHG B694-HL | 637 | GAGGTGCAGCTGTTGGAGTCTGGGGGAGGCTTGGTACAGCCTGGGGG GTCCCTGAGACTCTCCTGTGCAGCCTCTGGATTCACCTTTAGCAGCTAT GCCATGCACTGGGTCCGCCAGGCCCCAGGGAAGGGGCTGGACTGGGT CTCAGGTATTAGTGGTAGTGGCTTTAGCACATACTATGTAGACTCCGT GAAGGGCCGGTTCACCATCTCCAGAGACAATTCCAAGCACACGCTGT ATCTGCAAATGAACAGCCTGAGAGCCGAGGACACGGCCGTATATTAC TGTGCGAAAGATAATTTAGTGGCTGGTACCGTCTTTGACTACTGGGGC CAGGGAACCCTGGTCACCGTCTCCTCAGGCGGATCTGAGGGAAAGTC CAGCGGCTCCGGCAGCGAAAGCAAGTCCACCGGCGGAAGCGACATCC AGATGACCCAGTCTCCTTCCACCCTGTCTGCATCTGTAGGAGACAGAG TCACCATCACTTGCCGGGCCAGTCAGAGTATTAGTAGCTGGTTGGCCT GGTATCAGCAGAAACCAGGGAAAGCCCCTAAGCTCCTGATCTATAAG GCGTCTAGTTTAGAAAGTGGGGTCCCATCAAGGTTCAGCGGCAGTGG ATCTGGGACAGAATTCACTCTCACCATCAGCAGCCTGCAGCCTGATGA TTTTGCAACTTATTACTGCCAACAGTATAATAGTTATTCGCTCACTTTC GGCGGAGGGACCAAGGTGGATATCAAA |
| MHG B694-LH | 638 | GACATCCAGATGACCCAGTCTCCTTCCACCCTGTCTGCATCTGTAGGA GACAGAGTCACCATCACTTGCCGGGCCAGTCAGAGTATTAGTAGCTGG TTGGCCTGGTATCAGCAGAAACCAGGGAAAGCCCCTAAGCTCCTGATC TATAAGGCGTCTAGTTTAGAAAGTGGGGTCCCATCAAGGTTCAGCGGC AGTGGATCTGGGACAGAATTCACTCTCACCATCAGCAGCCTGCAGCCT GATGATTTTGCAACTTATTACTGCCAACAGTATAATAGTTATTCGCTCA CTTTCGGCGGAGGGACCAAGGTGGATATCAAAGGCGGATCTGAGGGA AAGTCCAGCGGCTCCGGCAGCGAAAGCAAGTCCACCGGCGGAAGCGA GGTGCAGCTGTTGGAGTCTGGGGGAGGCTTGGTACAGCCTGGGGGGT CCCTGAGACTCTCCTGTGCAGCCTCTGGATTCACCTTTAGCAGCTATGC CATGCACTGGGTCCGCCAGGCCCCAGGGAAGGGGCTGGACTGGGTCT CAGGTATTAGTGGTAGTGGCTTTAGCACATACTATGTAGACTCCGTGA AGGGCCGGTTCACCATCTCCAGAGACAATTCCAAGCACACGCTGTATC TGCAAATGAACAGCCTGAGAGCCGAGGACACGGCCGTATATTACTGT GCGAAAGATAATTTAGTGGCTGGTACCGTCTTTGACTACTGGGGCCAG GGAACCCTGGTCACCGTCTCCTCA |
| MHG B732-HL | 639 | CAAGTACAACTGCAACAAAGTGGTCCTGGGCTCGTGAAGCCTTCCCAG ACTCTCAGCCTCACATGCGCTATAAGTGGGGATTCTGTTTCCTCAAATT CAGCAGCCTGGAATTGGATACGACAGTCTCCATCCCGTGGCCTTGAGT GGCTTGGTAGAACTTATTACCGATCCAAGTGGTACAATGATTACGCCG TTTCAGTGAAGTCCCGCATTACTATTAATCCCGACACATCTAAGAATC AAATTTCATTGCAACTGAATAGCGTAACACCCGAAGATACAGCAGTTT ATTATTGTGCAGGTGATCGACGCTACGGCATAGTGGGACTTCCTTTCG CCTATTGGGGCCAAGGGACACTGGTCACTGTGTCATCCGGCGGATCTG AGGGAAAGTCCAGCGGCTCCGGCAGCGAAAGCAAGTCCACCGGCGGA AGCGACATCGTAATGACACAGTCACCAGATTCATTGGCAGTTAGTCTG GGTGAAAGGGCAACAATCAACTGCAAGTCTTCTCAGAGTGTACTGCAT AGTTCTAACAATAAGAACTACCTTACCTGGTTTCAACAGAAACCAGGT CAGCCCCCCAAGTTGCTGATTTACTGGGCAAGCACCCGCGAATCCGGC GTTCCCGATCGATTTTCAGGTTCCGGGAGTGGGACCGACTTTACCTTG ACCATCTCTTCCTTGCAGGCCGAAGATGTAGCCGTCTATTACTGCCAT CAGTATTACTCTACTCCCCCCACATTCGGTCAAGGTACAAAAGTTGAG ATAAAA |
| MHG B732-LH | 640 | GACATCGTAATGACACAGTCACCAGATTCATTGGCAGTTAGTCTGGGT GAAAGGGCAACAATCAACTGCAAGTCTTCTCAGAGTGTACTGCATAGT TCTAACAATAAGAACTACCTTACCTGGTTTCAACAGAAACCAGGTCAG CCCCCCAAGTTGCTGATTTACTGGGCAAGCACCCGCGAATCCGGCGTT CCCGATCGATTTTCAGGTTCCGGGAGTGGGACCGACTTTACCTTGACC ATCTCTTCCTTGCAGGCCGAAGATGTAGCCGTCTATTACTGCCATCAG TATTACTCTACTCCCCCCACATTCGGTCAAGGTACAAAAGTTGAGATA AAAGGCGGATCTGAGGGAAAGTCCAGCGGCTCCGGCAGCGAAAGCAA GTCCACCGGCGGAAGCCAAGTACAACTGCAACAAAGTGGTCCTGGGC TCGTGAAGCCTTCCCAGACTCTCAGCCTCACATGCGCTATAAGTGGGG |

TABLE 57-continued

| cDNA sequences of anti-HLA-G scFvs and scFv-Fcs. | | |
|---|---|---|
| scFv or scFv-Fc | cDNA SEQ ID NO: | cDNA |
| | | ATTCTGTTTCCTCAAATTCAGCAGCCTGGAATTGGATACGACAGTCTC CATCCCGTGGCCTTGAGTGGCTTGGTAGAACTTATTACCGATCCAAGT GGTACAATGATTACGCCGTTTCAGTGAAGTCCCGCATTACTATTAATC CCGACACATCTAAGAATCAAATTTCATTGCAACTGAATAGCGTAACAC CCGAAGATACAGCAGTTTATTATTGTGCAGGTGATCGACGCTACGGCA TAGTGGGACTTCCTTTCGCCTATTGGGGCCAAGGGACACTGGTCACTG TGTCATCC |
| MHG B737-HL | 641 | GAGGTGCAACTCCTTGAATCAGGCGGAGGACTCGTCCAACCTGGAGG GAGTCTTAGGCTTAGCTGTGCAGCCAGTGGCTTTACTTTTAGCAGCTA TGCAATGCACTGGGTCAGGCAGGCTCCTGGTAAGGGGCTCGAATGGG TCAGCGGCATATCCGGGTCAGGTTTCTCTACATATTATGTCGATTCTGT AAAAGGACGATTCACCATATCCAGAGACAATTCTAAAAATACCTTGTA TCTCCAGATGAACAGCCTGAGAGCAGAAGATACCGCAGTTTATTACTG TGCAAAGGATAATCTGGTTGCCGGGACAGTTTTTGATTATTGGGGGCA AGGCACCCTCGTCACAGTATCCAGTGGCGGATCTGAGGGAAAGTCCA GCGGCTCCGGCAGCGAAAGCAAGTCCACCGGCGGAAGCGATATTCAG ATGACTCAATCACCTTCAACCCTTAGCGCCTCCGTTGGAGATCGCGTT ACCATTACCTGCCGAGCCTCCCAAAGTATCAGCTCATGGTTGGCATGG TATCAACAGAAGCCTGGAAAGGCACCCAAACTTCTGATTTACAAAGC CAGCTCCTTGGAGTCAGGAGTCCCAAGCCGGTTCAGCGGATCTGGGTC AGGGACAGAATTTACCCTGACCATATCTTCCCTTCAGCCCGACGACTT CGCCACTTACTATTGTCAGCAATACAACTCCTATTCCCTGACTTTCGGC GGTGGCACAAAGGTTGACATCAAG |
| MHG B737-LH | 642 | GATATTCAGATGACTCAATCACCTTCAACCCTTAGCGCCTCCGTTGGA GATCGCGTTACCATTACCTGCCGAGCCTCCCAAAGTATCAGCTCATGG TTGGCATGGTATCAACAGAAGCCTGGAAAGGCACCCAAACTTCTGATT TACAAAGCCAGCTCCTTGGAGTCAGGAGTCCCAAGCCGGTTCAGCGG ATCTGGGTCAGGGACAGAATTTACCCTGACCATATCTTCCCTTCAGCC CGACGACTTCGCCACTTACTATTGTCAGCAATACAACTCCTATTCCCTG ACTTTCGGCGGTGGCACAAAGGTTGACATCAAGGGCGGATCTGAGGG AAAGTCCAGCGGCTCCGGCAGCGAAAGCAAGTCCACCGGCGGAAGCG AGGTGCAACTCCTTGAATCAGGCGGAGGACTCGTCCAACCTGGAGGG AGTCTTAGGCTTAGCTGTGCAGCCAGTGGCTTTACTTTTAGCAGCTAT GCAATGCACTGGGTCAGGCAGGCTCCTGGTAAGGGGCTCGAATGGGT CAGCGGCATATCCGGGTCAGGTTTCTCTACATATTATGTCGATTCTGTA AAAGGACGATTCACCATATCCAGAGACAATTCTAAAAATACCTTGTAT CTCCAGATGAACAGCCTGAGAGCAGAAGATACCGCAGTTTATTACTGT GCAAAGGATAATCTGGTTGCCGGGACAGTTTTTGATTATTGGGGGCAA GGCACCCTCGTCACAGTATCCAGT |
| MHG B738-HL | 643 | CAGGTGCAGCTTCAACAGAGCGGACCTGGTCTGGTTAAGCCTTCCCAA ACCCTGAGCCTGACTTGTGCTATTTCCGGGGATAGTGTTAGCTCCAAT AGGGCAGCATGGAACTGGATCAGACAGTCCCCAAGCCGTGGACTTGA GTGGCTTGGACGTACTTATTACAGGAGTAAATGGTACAATGATTATGC CGTTTCTGTGAAGAGCCGTATTACTATAAACCCAGATACTTCTAAAAA TCAAATTTCCCTTCAGCTCAACTCAGTTACACCAGAGGATACTGCAGT CTATTATTGCGCAAGAGTTCGACCTGGCATTCCCTTCGATTATTGGGG GCAGGGGACACCCGTTACTGTGTCCTCAGGCGGATCTGAGGGAAAGT CCAGCGGCTCCGGCAGCGAAAGCAAGTCCACCGGCGGAAGCGATATT GTTATGACACAGTCCCCAGATTCATTGGCAGTAAGCCTCGGTGAACGG GCTACTATTAACTGTAAGTCTTCCCAGAGTGTATTGTTCTCTTCAAATA ACAAAAACTACCTGGCATGGTATCAGCAAAAGCCTGGTCAACCCCCT AAACTTCTCATATACTGGGCATCCACTCGGGAGAGCGGTGTGCCAGAC CGTTTCTCAGGGAGTGTGTCAGGTACAGATTTTACACTCACAATTTCC AGCCTCCAAGCCGAAGACGTTGCAGTATATTATTGCCAACAATATCAC TCTACACCTTGGACATTTGGTCAAGGTACTAAAGTCGAAATCAAA |
| MHG B738-LH | 644 | GATATTGTTATGACACAGTCCCCAGATTCATTGGCAGTAAGCCTCGGT GAACGGGCTACTATTAACTGTAAGTCTTCCCAGAGTGTATTGTTCTCTT CAAATAACAAAAACTACCTGGCATGGTATCAGCAAAAGCCTGGTCAA CCCCCTAAACTTCTCATATACTGGGCATCCACTCGGGAGAGCGGTGTG CCAGACCGTTTCTCAGGGAGTGTGTCAGGTACAGATTTTACACTCACA ATTTCCAGCCTCCAAGCCGAAGACGTTGCAGTATATTATTGCCAACAA TATCACTCTACACCTTGGACATTTGGTCAAGGTACTAAAGTCGAAATC AAAGGCGGATCTGAGGGAAAGTCCAGCGGCTCCGGCAGCGAAAGCAA GTCCACCGGCGGAAGCCAGGTGCAGCTTCAACAGAGCGGACCTGGTC TGGTTAAGCCTTCCCAAACCCTGAGCCTGACTTGTGCTATTTCCGGGG ATAGTGTTAGCTCCAATAGGGCAGCATGGAACTGGATCAGACAGTCC CCAAGCCGTGGACTTGAGTGGCTTGGACGTACTTATTACAGGAGTAAA TGGTACAATGATTATGCCGTTTCTGTGAAGAGCCGTATTACTATAAAC CCAGATACTTCTAAAAATCAAATTTCCCTTCAGCTCAACTCAGTTACA |

TABLE 57-continued cDNA sequences of anti-HLA-G scFvs and scFv-Fcs.

| scFv or scFv-Fc | cDNA SEQ ID NO: | cDNA |
|---|---|---|
| | | CCAGAGGATACTGCAGTCTATTATTGCGCAAGAGTTCGACCTGGCATT<br>CCCTTCGATTATTGGGGGCAGGGGACACCCGTTACTGTGTCCTCA |
| MHG B665-HL-Fc | 645 | CAGGTGCAGCTGCAGCAGAGCGGCCCTGGACTGGTGAAGCCCAGCCA<br>GACCCTGAGCCTGACCTGCGCTATCAGCGGCGATAGCGTGAGCTCCAA<br>CAGCGCCGCCTGGAACTGGATCAGGCAGAGCCCTAGCAGGGGCCTGG<br>AATGGCTGGGCAGGACCTACTACAGGAGCAAGTGGTACAACGACTAC<br>GCCGTGTCCGTGAAGAGCAGGATCACCATCAACCCCGACACCAGCAA<br>GAACCAGATCAGCCTGCAGCTGAACAGCGTGACCCCCGAGGACACCG<br>CCGTGTACTACTGCGCCGGCGACAGAAGGTACGGCATCGTGGGCCTG<br>CCTTTCGCCTACTGGGGCCAGGGAACCCTGGTGACCGTGAGCAGCGGC<br>GGATCTGAGGGAAAGTCCAGCGGCTCCGGCAGCGAAAGCAAGTCCAC<br>CGGCGGAAGCGACATCGTGATGACCCAGAGCCCCGATAGCCTGGCTG<br>TGAGCCTGGGCGAGAGAGCCACCATCAACTGCAAGAGCAGCCAGAGC<br>GTGCTGCACAGCAGCAACAACAAGAACTACCTGACCTGGTTCCAGCA<br>GAAGCCCGGCCAGCCTCCCAAGCTGCTGATCTACTGGGCTAGCACCAG<br>AGAGTCCGGCGTGCCTGACAGGTTCAGCGGAAGCGGCAGCGGCACCG<br>ACTTCACCCTGACCATCAGCAGCCTGCAGGCCGAGGACGTGGCCGTGT<br>ACTACTGCCACCAGTACTACAGCACCCCCCCTACCTTTGGCCAGGGCA<br>CCAAGGTGGAGATCAAGGAGCCCAAATCTAGCGACAAAACTCACACT<br>TGTCCACCGTGCCCAGCACCTGAAGCAGCAGGGGGACCGTCAGTCTTC<br>CTCTTCCCCCCAAAACCCAAGGACACCCTCATGATCTCCCGGACCCCT<br>GAGGTCACATGCGTGGTGGTGAGCGTGAGCCACGAAGACCCTGAGGT<br>CAAGTTCAACTGGTACGTGGACGGCGTGGAGGTGCATAATGCCAAGA<br>CAAAGCCGCGGGAGGAGCAGTACAACAGCACGTACCGTGTGGTCAGC<br>GTCCTCACCGTCCTGCACCAGGACTGGCTGAATGGCAAGGAGTACAA<br>GTGCAAGGTGTCCAACAAAGCCCTCCCAGCCCCCATCGAGAAAACCA<br>TCTCCAAAGCCAAAGGGCAGCCCCGAGAACCACAGGTGTACGTGCTG<br>CCCCCATCCCGGGAGGAGATGACCAAGAACCAGGTCAGCCTGCTGTG<br>CCTGGTCAAAGGCTTCTATCCCAGCGACATCGCCGTGGAGTGGGAGA<br>GCAATGGGCAGCCGGAGAACAACTACCTCACCTGGCCTCCCGTGCTG<br>GACTCCGACGGCTCCTTCTTCCTCTACAGCAAGCTCACCGTGGACAAG<br>TCCAGATGGCAGCAGGGGAACGTCTTCTCATGCTCCGTGATGCATGAG<br>GCTCTGCACAACCACTACACGCAGAAGTCTCTCTCCCTGTCTCCGGGA<br>AAA |
| MHG B665-LH-Fc | 646 | GACATCGTGATGACCCAGAGCCCCGATAGCCTGGCTGTGAGCCTGGG<br>CGAGAGAGCCACCATCAACTGCAAGAGCAGCCAGAGCGTGCTGCACA<br>GCAGCAACAACAAGAACTACCTGACCTGGTTCCAGCAGAAGCCCGGC<br>CAGCCTCCCAAGCTGCTGATCTACTGGGCTAGCACCAGAGAGTCCGGC<br>GTGCCTGACAGGTTCAGCGGAAGCGGCAGCGGCACCGACTTCACCCT<br>GACCATCAGCAGCCTGCAGGCCGAGGACGTGGCCGTGTACTACTGCC<br>ACCAGTACTACAGCACCCCCCCTACCTTTGGCCAGGGCACCAAGGTGG<br>AGATCAAGGGCGGATCTGAGGGAAAGTCCAGCGGCTCCGGCAGCGAA<br>AGCAAGTCCACCGGCGGAAGCCAGGTGCAGCTGCAGCAGAGCGGCCC<br>TGGACTGGTGAAGCCCAGCCAGACCCTGAGCCTGACCTGCGCTATCAG<br>CGGCGATAGCGTGAGCTCCAACAGCGCCGCCTGGAACTGGATCAGGC<br>AGAGCCCTAGCAGGGGCCTGGAATGGCTGGGCAGGACCTACTACAGG<br>AGCAAGTGGTACAACGACTACGCCGTGTCCGTGAAGAGCAGGATCAC<br>CATCAACCCCGACACCAGCAAGAACCAGATCAGCCTGCAGCTGAACA<br>GCGTGACCCCCGAGGACACCGCCGTGTACTACTGCGCCGGCGACAGA<br>AGGTACGGCATCGTGGGCCTGCCTTTCGCCTACTGGGGCCAGGGAACC<br>CTGGTGACCGTGAGCAGCgagcccaaatctagcgacaaaactcacacttgtccaccgtgcccagc<br>acctgaagcagcagggggaccgtcagtcttcctcttccccccaaaacccaaggacaccctcatgatctcccggacc<br>cctgaggtcacatgcgtggtggtgagcgtgagccacgaagaccctgaggtcaagttcaactggtacgtggacggc<br>gtggaggtgcataatgccaagacaaagccgcgggaggagcagtacaacagcacgtaccgtgtggtcagcgtcctc<br>accgtcctgcaccaggactggctgaatggcaaggagtacaagtgcaaggtgtccaacaaagccctcccagcccccc<br>atcgagaaaaccatctccaaagccaaagggcagccccgagaaccacaggtgtacgtgctgcccccatcccggga<br>ggagatgaccaagaaccaggtcagcctgctgtgcctggtcaaaggcttctatcccagcgacatcgccgtggagtgg<br>gagagcaatgggcagccggagaacaactacctcacctggcctcccgtgctggactccgacggctccttcttcctcta<br>cagcaagctcaccgtggacaagtccagatggcagcaggggaacgtcttctcatgctccgtgatgcatgaggctctg<br>cacaaccactacacgcagaagtctctctccctgtctccgggaaaa |
| MHG B668-HL-Fc | 647 | CAGGTGCAGCTGCAGCAGAGCGGACCCGGCCTGGTGAAACCCAGCCA<br>GACCCTGAGCCTGACCTGCGCCATCAGCGGCGACAGCGTGAGCAACA<br>ACAGCGCCGCCTGGAACTGGATCAGGCAGAGCCCCAGCAGAGGCCTG<br>GAATGGCTGGGCAGGACCTACTACAGGAGCAAGTGGTACAACGACTA<br>CGCCGTGAGCGTGAAGAGCAGGATCACCATCAACCCCGACACCTCCA<br>AGAACCAGTTCAGCCTGCAGCTGAACAGCGTGACCCCCGAGGACACC<br>GCCGTGTACTACTGCGCCAGGTATGGCAGCGGCACCCTGCTGTTCGAC<br>TACTGGGGCCAGGGCACCCTGGTGACAGTGAGCAGCGGCGGATCTGA<br>GGGAAAGTCCAGCGGCTCCGGCAGCGAAAGCAAGTCCACCGGCGGAA<br>GCGACATCGTGATGACCCAGAGCCCCGATAGCCTGGCTGTGAGCCTG |

TABLE 57-continued cDNA sequences of anti-HLA-G scFvs and scFv-Fcs.

| scFv or scFv-Fc | cDNA SEQ ID NO: | cDNA |
|---|---|---|
| | | GGAGAGAGGGCCACCATCAACTGCAAGAGCAGCCAGAGCGTGCTGTA<br>CAGCAGCAAGAACAAGAACTACCTGGCCTGGTACCAGCAGAAACCCG<br>GCCAGCCCCCCAAGCTGCTGATCTACTGGGCCAGCACAAGGGAAAGC<br>GGCGTGCCCGACAGATTCAGCGGAAGCGGCAGCGGCACCGACTTCAC<br>CCTGACCATCAGCAGCCTGCAGGCCGAGGATGTGGCCGTGTACTACTG<br>CCAGCAGTACTACAGCACCTTCCCCTACACCTTCGGCCAGGGCACCAA<br>GCTGGAGATCAAGgagcccaaatctagcgacaaaactcacacttgtccaccgtgcccagcacctgaag<br>cagcagggggaccgtcagtcttcctcttccccccaaaacccaaggacaccctcatgatctcccggacccctgaggt<br>cacatgcgtggtggtgagcgtgagccacgaagaccctgaggtcaagttcaactggtacgtggacggcgtggaggt<br>gcataatgccaagacaaagccgcgggaggagcagtacaacagcacgtaccgtgtggtcagcgtcctcaccgtcct<br>gcaccaggactggctgaatggcaaggagtacaagtgcaaggtgtccaacaaagccctcccagcccccatcgaga<br>aaaccatctccaaagccaaagggcagccccgagaaccacaggtgtacgtgctgcccccatcccgggaggagatg<br>accaagaaccaggtcagcctgctgtgcctggtcaaaggcttctatcccagcgacatcgccgtggagtgggagagca<br>atgggcagccggagaacaactacctcacctggcctcccgtgctggactccgacggctccttcttcctctacagcaag<br>ctcaccgtggacaagtccagatggcagcaggggaacgtcttctcatgctccgtgatgcatgaggctctgcacaacca<br>ctacacgcagaagtctctctccctgtctccgggaaaa |
| MHG B668-LH-Fc | 648 | GACATCGTGATGACCCAGAGCCCCGATAGCCTGGCTGTGAGCCTGGG<br>AGAGAGGGCCACCATCAACTGCAAGAGCAGCCAGAGCGTGCTGTACA<br>GCAGCAAGAACAAGAACTACCTGGCCTGGTACCAGCAGAAACCCGGC<br>CAGCCCCCCAAGCTGCTGATCTACTGGGCCAGCACAAGGGAAAGCGG<br>CGTGCCCGACAGATTCAGCGGAAGCGGCAGCGGCACCGACTTCACCC<br>TGACCATCAGCAGCCTGCAGGCCGAGGATGTGGCCGTGTACTACTGCC<br>AGCAGTACTACAGCACCTTCCCCTACACCTTCGGCCAGGGCACCAAGC<br>TGGAGATCAAGGGCGGATCTGAGGGAAAGTCCAGCGGCTCCGGCAGC<br>GAAAGCAAGTCCACCGGCGGAAGCCAGGTGCAGCTGCAGCAGAGCGG<br>ACCCGGCCTGGTGAAACCCAGCCAGACCCTGAGCCTGACCTGCGCCAT<br>CAGCGGCGACAGCGTGAGCAACAACAGCGCCGCCTGGAACTGGATCA<br>GGCAGAGCCCCAGCAGAGGCCTGGAATGGCTGGGCAGGACCTACTAC<br>AGGAGCAAGTGGTACAACGACTACGCCGTGAGCGTGAAGAGCAGGAT<br>CACCATCAACCCCGACACCTCCAAGAACCAGTTCAGCCTGCAGCTGAA<br>CAGCGTGACCCCCGAGGACACCGCCGTGTACTACTGCGCCAGGTATG<br>GCAGCGGCACCCTGCTGTTCGACTACTGGGGCCAGGGCACCCTGGTGA<br>CAGTGAGCAGCgagcccaaatctagcgacaaaactcacacttgtccaccgtgcccagcacctgaagcag<br>caggggggaccgtcagtcttcctcttccccccaaaacccaaggacaccctcatgatctcccggacccctgaggtcaca<br>tgcgtggtggtgagcgtgagccacgaagaccctgaggtcaagttcaactggtacgtggacggcgtggaggtgcat<br>aatgccaagacaaagccgcgggaggagcagtacaacagcacgtaccgtgtggtcagcgtcctcaccgtcctgcac<br>caggactggctgaatggcaaggagtacaagtgcaaggtgtccaacaaagccctcccagcccccatcgagaaaacc<br>atctccaaagccaaagggcagccccgagaaccacaggtgtacgtgctgcccccatcccgggaggagatgaccaa<br>gaaccaggtcagcctgctgtgcctggtcaaaggcttctatcccagcgacatcgccgtggagtgggagagcaatggg<br>cagccggagaacaactacctcacctggcctcccgtgctggactccgacggctccttcttcctctacagcaagctcac<br>cgtggacaagtccagatggcagcaggggaacgtcttctcatgctccgtgatgcatgaggctctgcacaaccactaca<br>cgcagaagtctctctccctgtctccgggaaaa |
| MHG B669-HL-Fc | 649 | CAGGTGCAGCTGCAGCAGAGCGGACCCGGACTGGTGAGACCCAGCCA<br>GACCCTGAGCGTGACCTGCGCCATCAGCGGCGACAGCGTGAGCAGCA<br>ACAGCGCCAGCTGGAACTGGATCAGGCAGAGCCCCAGCAGAGGCCTG<br>GAGTGGCTGGGAAGGACATACTACAGGAGCGAGTGGTTCAACGACTA<br>CGCCGTGAGCGTGAAGAGCAGGGTGACCATCAACCCCGACACCAGCA<br>AGAACCAGCTGAGCCTGCAGCTGAACAGCGTGATCCCCGAGGACACC<br>GCCGTGTACTACTGCGCCAGAGAGGCCAGAATCGGCGTGGCCGGCAA<br>AGGCTTCGACTACTGGGGCCAGGGCACCCTGGTGACAGTGTCCAGCG<br>GCGGATCTGAGGGAAAGTCCAGCGGCTCCGGCAGCGAAAGCAAGTCC<br>ACCGGCGGAAGCGACATCGTGATGACCCAGAGCCCTGACTCCCTGGC<br>TGTGAGCCTGGGCGAGAGAGCCACCATCAACTGCAAGAGCAGCCAGA<br>GCGTGCTGTTCAGGAGCAACAACAAGAACTACCTGGCCTGGTTCCAGC<br>AGAAGCCCGGCCAGCCTCCCAAGCTGCTGATCTACTGGGCCAGCACC<br>AGAGAGAGCGGCGTGCCCGATAGATTTAGCGGCAGCGGCAGCGGCAC<br>CGACTTTACCCTGACCATCAGCTCCCTGCAGGCCGAGGATGTGGCCGT<br>GTACTACTGCCAGCAGTACTACAGCACCCCCAGAACCTTCGGCCAGGG<br>CACCAAGGTGGAGATCAAGgagcccaaatctagcgacaaaactcacacttgtccaccgtgccca<br>gcacctgaagcagcaggggggaccgtcagtcttcctcttccccccaaaacccaaggacaccctcatgatctcccgga<br>cccctgaggtcacatgcgtggtggtgagcgtgagccacgaagaccctgaggtcaagttcaactggtacgtggacg<br>gcgtggaggtgcataatgccaagacaaagccgcgggaggagcagtacaacagcacgtaccgtgtggtcagcgtc<br>ctcaccgtcctgcaccaggactggctgaatggcaaggagtacaagtgcaaggtgtccaacaaagccctcccagcc<br>cccatcgagaaaaccatctccaaagccaaagggcagccccgagaaccacaggtgtacgtgctgcccccatcccg<br>ggaggagatgaccaagaaccaggtcagcctgctgtgcctggtcaaaggcttctatcccagcgacatcgccgtgga<br>gtgggagagcaatgggcagccggagaacaactacctcacctggcctcccgtgctggactccgacggctccttcttc<br>ctctacagcaagctcaccgtggacaagtccagatggcagcaggggaacgtcttctcatgctccgtgatgcatgagg<br>ctctgcacaaccactacacgcagaagtctctctccctgtctccgggaaaa |

TABLE 57-continued cDNA sequences of anti-HLA-G scFvs and scFv-Fcs.

| scFv or scFv-Fc | cDNA SEQ ID NO: | cDNA |
|---|---|---|
| MHG B669-LH-Fc | 650 | GACATCGTGATGACCCAGAGCCCTGACTCCCTGGCTGTGAGCCTGGGC<br>GAGAGAGCCACCATCAACTGCAAGAGCAGCCAGAGCGTGCTGTTCAG<br>GAGCAACAACAAGAACTACCTGGCCTGGTTCCAGCAGAAGCCCGGCC<br>AGCCTCCCAAGCTGCTGATCTACTGGGCCAGCACCAGAGAGAGCGGC<br>GTGCCCGATAGATTTAGCGGCAGCGGCAGCGGCACCGACTTTACCCTG<br>ACCATCAGCTCCCTGCAGGCCGAGGATGTGGCCGTGTACTACTGCCAG<br>CAGTACTACAGCACCCCCAGAACCTTCGGCCAGGGCACCAAGGTGGA<br>GATCAAGGGCGGATCTGAGGGAAAGTCCAGCGGCTCCGGCAGCGAAA<br>GCAAGTCCACCGGCGGAAGCCAGGTGCAGCTGCAGCAGAGCGGACCC<br>GGACTGGTGAGACCCAGCCAGACCCTGAGCGTGACCTGCGCCATCAG<br>CGGCGACAGCGTGAGCAGCAACAGCGCCAGCTGGAACTGGATCAGGC<br>AGAGCCCCAGCAGAGGCCTGGAGTGGCTGGGAAGGACATACTACAGG<br>AGCGAGTGGTTCAACGACTACGCCGTGAGCGTGAAGAGCAGGGTGAC<br>CATCAACCCCGACACCAGCAAGAACCAGCTGAGCCTGCAGCTGAACA<br>GCGTGATCCCCGAGGACACCGCCGTGTACTACTGCGCCAGAGAGGCC<br>AGAATCGGCGTGGCCGGCAAAGGCTTCGACTACTGGGGCCAGGGCAC<br>CCTGGTGACAGTGTCCAGCgagcccaaatctagcgacaaaactcacacttgtccaccgtgcccag<br>cacctgaagcagcaggggggaccgtcagtcttcctcttccccccaaaacccaaggacaccctcatgatctcccggac<br>ccctgaggtcacatgcgtggtggtgagcgtgagccacgaagaccctgaggtcaagttcaactggtacgtggacgg<br>cgtggaggtgcataatgccaagacaaagccgcgggaggagcagtacaacagcacgtaccgtgtggtcagcgtcct<br>caccgtcctgcaccaggactggctgaatggcaaggagtacaagtgcaaggtgtccaacaaagccctcccagcccc<br>catcgagaaaaccatctccaaagccaaagggcagccccgagaaccacaggtgtacgtgctgcccccatcccggg<br>aggagatgaccaagaaccaggtcagcctgctgtgcctggtcaaaggcttctatcccagcgacatcgccgtggagtg<br>ggagagcaatgggcagccggagaacaactacctcacctggcctcccgtgctggactccgacggctccttcttcctct<br>acagcaagctcaccgtggacaagtccagatggcagcaggggaacgtcttctcatgctccgtgatgcatgaggctct<br>gcacaaccactacacgcagaagtctctctccctgtctccgggaaaa |
| MHG B672-HL-Fc | 651 | CAGGTGCAGCTGCAGCAGAGCGGACCTGGCCTGGTGAAGCCCAGCCA<br>GACCCTGAGCCTGACATGCGCCATCAGCGGCGACAGCGTGAGCAGCA<br>ATAGGGCCGCCTGGAACTGGATCAGGCAGACCCCTAGCAGGGGCCTG<br>GAATGGCTGGGCAGGACATACTACAGGAGCGAGTGGTACAACGACTA<br>CGCCGTGTCCGTGAAGAGCAGGATCACCATCAACCCCGACACCAGCA<br>AGAACCAGTTCAGCCTGCAGCTGAACAGCGTGACCCCCGAGGACACC<br>GCCGTGTACTACTGCGCCAGAGTGAGAGCCGCCGTGCCTTTCGACTAC<br>TGGGGCCAGGGCACCCTGGTGACAGTGAGCAGCGGCGGATCTGAGGG<br>AAAGTCCAGCGGCTCCGGCAGCGAAAGCAAGTCCACCGGCGGAAGCG<br>ACATCGTGATGACCCAGAGCCCCGATAGCCTGGCTGTGAGCCTGGGC<br>GAGAGGGCCACCATCAACTGCAAGAGCAGCCAGAGCGTGCTGTTTTC<br>CAGCAACAACAAGAACTACCTGGCCTGGTACCAGCAGAAACCCGGCC<br>AGCCCCCCAACCTGCTGATCTACTGGGCCAGCACCAGAGAAAGCGGC<br>GTGCCCGACAGGTTTAGCGGCAGCGTGAGCGGCACCGACTTCACCCTG<br>ACCATCAGCAGCCTGCAGGCCGAGGACGTGGCCATCTACTACTGCCA<br>GCAGTACCACAGCACCCCCTGGACATTCGGCCAGGGCACCAAGGTGG<br>AGATCAAGgagcccaaatctagcgacaaaactcacacttgtccaccgtgcccagcacctgaagcagcagg<br>gggaccgtcagtcttcctcttccccccaaaacccaaggacaccctcatgatctcccggacccctgaggtcacatgcg<br>tggtggtgagcgtgagccacgaagaccctgaggtcaagttcaactggtacgtggacggcgtggaggtgcataatgc<br>caagacaaagccgcgggaggagcagtacaacagcacgtaccgtgtggtcagcgtcctcaccgtcctgcaccagg<br>actggctgaatggcaaggagtacaagtgcaaggtgtccaacaaagccctcccagcccccatcgagaaaaccatctc<br>caaagccaaagggcagccccgagaaccacaggtgtacgtgctgcccccatcccgggaggagatgaccaagaac<br>caggtcagcctgctgtgcctggtcaaaggcttctatcccagcgacatcgccgtggagtgggagagcaatgggcagc<br>cggagaacaactacctcacctggcctcccgtgctggactccgacggctccttcttcctctacagcaagctcaccgtg<br>gacaagtccagatggcagcaggggaacgtcttctcatgctccgtgatgcatgaggctctgcacaaccactacacgc<br>agaagtctctctccctgtctccgggaaaa |
| MHG B672-LH-Fc | 652 | GACATCGTGATGACCCAGAGCCCCGATAGCCTGGCTGTGAGCCTGGG<br>CGAGAGGGCCACCATCAACTGCAAGAGCAGCCAGAGCGTGCTGTTTT<br>CCAGCAACAACAAGAACTACCTGGCCTGGTACCAGCAGAAACCCGGC<br>CAGCCCCCCAACCTGCTGATCTACTGGGCCAGCACCAGAGAAAGCGG<br>CGTGCCCGACAGGTTTAGCGGCAGCGTGAGCGGCACCGACTTCACCCT<br>GACCATCAGCAGCCTGCAGGCCGAGGACGTGGCCATCTACTACTGCC<br>AGCAGTACCACAGCACCCCCTGGACATTCGGCCAGGGCACCAAGGTG<br>GAGATCAAGGGCGGATCTGAGGGAAAGTCCAGCGGCTCCGGCAGCGA<br>AAGCAAGTCCACCGGCGGAAGCCAGGTGCAGCTGCAGCAGAGCGGAC<br>CTGGCCTGGTGAAGCCCAGCCAGACCCTGAGCCTGACATGCGCCATCA<br>GCGGCGACAGCGTGAGCAGCAATAGGGCCGCCTGGAACTGGATCAGG<br>CAGACCCCTAGCAGGGGCCTGGAATGGCTGGGCAGGACATACTACAG<br>GAGCGAGTGGTACAACGACTACGCCGTGTCCGTGAAGAGCAGGATCA<br>CCATCAACCCCGACACCAGCAAGAACCAGTTCAGCCTGCAGCTGAAC<br>AGCGTGACCCCCGAGGACACCGCCGTGTACTACTGCGCCAGAGTGAG<br>AGCCGCCGTGCCTTTCGACTACTGGGGCCAGGGCACCCTGGTGACAGT<br>GAGCAGCgagcccaaatctagcgacaaaactcacacttgtccaccgtgcccagcacctgaagcagcagggg<br>gaccgtcagtcttcctcttccccccaaaacccaaggacaccctcatgatctcccggacccctgaggtcacatgcgtg |

TABLE 57-continued cDNA sequences of anti-HLA-G scFvs and scFv-Fcs.

| scFv or scFv-Fc | cDNA SEQ ID NO: | cDNA |
|---|---|---|
| | | gtggtgagcgtgagccacgaagaccctgaggtcaagttcaactggtacgtggacggcgtggaggtgcataatgcc<br>aagacaaagccgcgggaggagcagtacaacagcacgtaccgtgtggtcagcgtcctcaccgtcctgcaccagga<br>ctggctgaatggcaaggagtacaagtgcaaggtgtccaacaaagccctcccagcccccatcgagaaaaccatctcc<br>aaagccaaagggcagccccgagaaccacaggtgtacgtgctgcccccatcccgggaggagatgaccaagaacc<br>aggtcagcctgctgtgcctggtcaaaggcttctatcccagcgacatcgccgtggagtgggagagcaatgggcagcc<br>ggagaacaactacctcacctggcctcccgtgctggactccgacggctccttcttcctctacagcaagctcaccgtgg<br>acaagtccagatggcagcaggggaacgtcttctcatgctccgtgatgcatgaggctctgcacaaccactacacgca<br>gaagtctctctccctgtctccgggaaaa |
| MHG B687-HL-Fc | 653 | CAGCTGCAGCTGCAGGAGAGCGGCCCTGGACTGGTGAAGCCCAGCGA<br>GACCCTGAGCCTGATGTGCACCGTGAGCGGCGGCAGCATCACCAGCA<br>GCAGCTACTACTGGGGATGGATCAGACAGCCCCCTGGCAAGGGCCTG<br>GAGTGGATCGGCAACATCTACTACAGCGGCACCACCTACTACAACCCC<br>AGCCTGAAGAGCAGGGTGACCATCAGCGTGGACACCAGCAAGAACCA<br>GTTCAGCCTGAAGCTGAGCAGCGTGACAGCTGCCGACACCGCCGTGT<br>ACTACTGTGCCGCCGGAGCCAGAGACTTCGACAGCTGGGGACAGGGC<br>AGCCTGGTGACCGTGTCCAGCGGCGGATCTGAGGGAAAGTCCAGCGG<br>CTCCGGCAGCGAAAGCAAGTCCACCGGCGGAAGCGACATCGTGATGA<br>CCCAGAGCCCTGATAGCCTGGCCGTGAGCCTGGGAGAGAGAGCCACC<br>ATCAACTGCAAGTCCTCCCAGAGCGTGCTGTACAGCTCCAGCAACAAG<br>AGCTACCTGGCCTGGTACCAGCAGAGGCCCGGACAGCCTCCCAAGCT<br>GCTGATCTACTGGGCCAGCACCAGAGAGAGCGGCGTGCCTGACAGGT<br>TTAGCGGCTCCGGCTCCGGCACCGACTTTACCCTGACCATCAGCAGCC<br>TGCAGGCCGAGGATGTGGCCGTGTACTACTGCCAGCAGTACTACAGC<br>ACCCCCAGGATGTACACCTTCGGCCAGGGCACCAAGCTGGAGATCAA<br>Ggagcccaaatctagcgacaaaactcacacttgtccaccgtgcccagcacctgaagcagcaggggggaccgtcag<br>tcttcctcttccccccaaaacccaaggacaccctcatgatctcccggacccctgaggtcacatgcgtggtggtgagc<br>gtgagccacgaagaccctgaggtcaagttcaactggtacgtggacggcgtggaggtgcataatgccaagacaaag<br>ccgcgggaggagcagtacaacagcacgtaccgtgtggtcagcgtcctcaccgtcctgcaccaggactggctgaat<br>ggcaaggagtacaagtgcaaggtgtccaacaaagccctcccagcccccatcgagaaaaccatctccaaagccaaa<br>gggcagccccgagaaccacaggtgtacgtgctgcccccatcccgggaggagatgaccaagaaccaggtcagcct<br>gctgtgcctggtcaaaggcttctatcccagcgacatcgccgtggagtgggagagcaatgggcagccggagaacaa<br>ctacctcacctggcctcccgtgctggactccgacggctccttcttcctctacagcaagctcaccgtggacaagtccag<br>atggcagcaggggaacgtcttctcatgctccgtgatgcatgaggctctgcacaaccactacacgcagaagtctctctc<br>cctgtctccgggaaaa |
| MHG B687-LH-Fc | 654 | GACATCGTGATGACCCAGAGCCCTGATAGCCTGGCCGTGAGCCTGGG<br>AGAGAGAGCCACCATCAACTGCAAGTCCTCCCAGAGCGTGCTGTACA<br>GCTCCAGCAACAAGAGCTACCTGGCCTGGTACCAGCAGAGGCCCGGA<br>CAGCCTCCCAAGCTGCTGATCTACTGGGCCAGCACCAGAGAGAGCGG<br>CGTGCCTGACAGGTTTAGCGGCTCCGGCTCCGGCACCGACTTTACCCT<br>GACCATCAGCAGCCTGCAGGCCGAGGATGTGGCCGTGTACTACTGCC<br>AGCAGTACTACAGCACCCCCAGGATGTACACCTTCGGCCAGGGCACC<br>AAGCTGGAGATCAAGGGCGGATCTGAGGGAAAGTCCAGCGGCTCCGG<br>CAGCGAAAGCAAGTCCACCGGCGGAAGCCAGCTGCAGCTGCAGGAGA<br>GCGGCCCTGGACTGGTGAAGCCCAGCGAGACCCTGAGCCTGATGTGC<br>ACCGTGAGCGGCGGCAGCATCACCAGCAGCAGCTACTACTGGGGATG<br>GATCAGACAGCCCCCTGGCAAGGGCCTGGAGTGGATCGGCAACATCT<br>ACTACAGCGGCACCACCTACTACAACCCCAGCCTGAAGAGCAGGGTG<br>ACCATCAGCGTGGACACCAGCAAGAACCAGTTCAGCCTGAAGCTGAG<br>CAGCGTGACAGCTGCCGACACCGCCGTGTACTACTGTGCCGCCGGAGC<br>CAGAGACTTCGACAGCTGGGGACAGGGCAGCCTGGTGACCGTGTCCA<br>GCgagcccaaatctagcgacaaaactcacacttgtccaccgtgcccagcacctgaagcagcaggggggaccgtca<br>gtcttcctcttccccccaaaacccaaggacaccctcatgatctcccggacccctgaggtcacatgcgtggtggtgag<br>cgtgagccacgaagaccctgaggtcaagttcaactggtacgtggacggcgtggaggtgcataatgccaagacaaa<br>gccgcgggaggagcagtacaacagcacgtaccgtgtggtcagcgtcctcaccgtcctgcaccaggactggctgaa<br>tggcaaggagtacaagtgcaaggtgtccaacaaagccctcccagcccccatcgagaaaaccatctccaaagccaa<br>agggcagccccgagaaccacaggtgtacgtgctgcccccatcccgggaggagatgaccaagaaccaggtcagc<br>ctgctgtgcctggtcaaaggcttctatcccagcgacatcgccgtggagtgggagagcaatgggcagccggagaac<br>aactacctcacctggcctcccgtgctggactccgacggctccttcttcctctacagcaagctcaccgtggacaagtcc<br>agatggcagcaggggaacgtcttctcatgctccgtgatgcatgaggctctgcacaaccactacacgcagaagtctct<br>ctccctgtctccgggaaaa |
| MHG B688-HL-Fc | 655 | GAGGTGCAGCTGTTGGAGTCAGGTCCAGGACTGGTGAAGCCCTCGCA<br>GACCCTCTCACTCACCTGTGTCATCTCCGGGGACAGTGTCTCTAGCAA<br>CAGAGCTGCTTGGAACTGGATCAGGCAGTCCCCATCGAGAGGCCTTG<br>AGTGGCTGGGAAGGACATACTACAGGTCCAAGTGGTATAATGATTAT<br>GCAGTATCTGTGAAAAGTCGAATAACCATCAATTCAGACACATCCAA<br>GAACCAGATCTCCCTGCAGTTGAACTCTGTGACTCCCGAGGACACGGC<br>TGTGTATTACTGTGCAAGAGTGAGACCGGGGATCCCATTTGACTACTG<br>GGGCCAGGGAACCCCGGTCACCGTCTCCTCAGGCGGATCTGAGGGAA<br>AGTCCAGCGGCTCCGGCAGCGAAAGCAAGTCCACCGGCGGAAGCGAC<br>ATCGTGATGACCCAGTCTCCAGACTCCCTGGCTGTGTCTCTGGGCGAG |

TABLE 57-continued cDNA sequences of anti-HLA-G scFvs and scFv-Fcs.

| scFv or scFv-Fc | cDNA SEQ ID NO: | cDNA |
|---|---|---|
| | | AGGGCCACCATCAACTGCAAGTCCAGCCAGAGTGTTTTATTCAGCTCC<br>AACAAAAAGAACTACTTAGCTTGGTACCAGCAGAAACCAGGACAGCC<br>CCCTAAGCTGCTCATTTACTGGGCATCTACCCGGGAATCCGGGGTCCC<br>TGACCGATTCAGTGGCAGCGGGTCTGGGACAGATTTCACTCTCACCAT<br>CAGCAGCCTGCAGGCTGAAGATGTGGCAGTTTATTACTGTCAGCAATA<br>TAATAGTACTCCGTGGACGTTCGGCCAAGGGACCAAGGTGGAGATCA<br>AAgagcccaaatctagcgacaaaactcacacttgtccaccgtgcccagcacctgaagcagcaggggggaccgtca<br>gtcttcctcttccccccaaaacccaaggacaccctcatgatctcccggacccctgaggtcacatgcgtggtggtgag<br>cgtgagccacgaagaccctgaggtcaagttcaactggtacgtggacggcgtggaggtgcataatgccaagacaaa<br>gccgcgggaggagcagtacaacagcacgtaccgtgtggtcagcgtcctcaccgtcctgcaccaggactggctgaa<br>tggcaaggagtacaagtgcaaggtgtccaacaaagccctcccagcccccatcgagaaaaccatctccaaagccaa<br>agggcagccccgagaaccacaggtgtacgtgctgcccccatcccgggaggagatgaccaagaaccaggtcagc<br>ctgctgtgcctggtcaaaggcttctatcccagcgacatcgccgtggagtgggagagcaatgggcagccggagaac<br>aactacctcacctggcctcccgtgctggactccgacggctccttcttcctctacagcaagctcaccgtggacaagtcc<br>agatggcagcaggggaacgtcttctcatgctccgtgatgcatgaggctctgcacaaccactacacgcagaagtctct<br>ctccctgtctccgggaaaa |
| MHG B688-LH-Fc | 656 | GACATCGTGATGACCCAGTCTCCAGACTCCCTGGCTGTGTCTCTGGGC<br>GAGAGGGCCACCATCAACTGCAAGTCCAGCCAGAGTGTTTTATTCAGC<br>TCCAACAAAAAGAACTACTTAGCTTGGTACCAGCAGAAACCAGGACA<br>GCCCCCTAAGCTGCTCATTTACTGGGCATCTACCCGGGAATCCGGGGT<br>CCCTGACCGATTCAGTGGCAGCGGGTCTGGGACAGATTTCACTCTCAC<br>CATCAGCAGCCTGCAGGCTGAAGATGTGGCAGTTTATTACTGTCAGCA<br>ATATAATAGTACTCCGTGGACGTTCGGCCAAGGGACCAAGGTGGAGA<br>TCAAAGGCGGATCTGAGGGAAAGTCCAGCGGCTCCGGCAGCGAAAGC<br>AAGTCCACCGGCGGAAGCGAGGTGCAGCTGTTGGAGTCAGGTCCAGG<br>ACTGGTGAAGCCCTCGCAGACCCTCTCACTCACCTGTGTCATCTCCGG<br>GGACAGTGTCTCTAGCAACAGAGCTGCTTGGAACTGGATCAGGCAGT<br>CCCCATCGAGAGGCCTTGAGTGGCTGGGAAGGACATACTACAGGTCC<br>AAGTGGTATAATGATTATGCAGTATCTGTGAAAAGTCGAATAACCATC<br>AATTCAGACACATCCAAGAACCAGATCTCCCTGCAGTTGAACTCTGTG<br>ACTCCCGAGGACACGGCTGTGTATTACTGTGCAAGAGTGAGACCGGG<br>GATCCCATTTGACTACTGGGGCCAGGGAACCCCGGTCACCGTCTCCTC<br>Agagcccaaatctagcgacaaaactcacacttgtccaccgtgcccagcacctgaagcagcaggggggaccgtcag<br>tcttcctcttccccccaaaacccaaggacaccctcatgatctcccggacccctgaggtcacatgcgtggtggtgagc<br>gtgagccacgaagaccctgaggtcaagttcaactggtacgtggacggcgtggaggtgcataatgccaagacaaag<br>ccgcgggaggagcagtacaacagcacgtaccgtgtggtcagcgtcctcaccgtcctgcaccaggactggctgaat<br>ggcaaggagtacaagtgcaaggtgtccaacaaagccctcccagcccccatcgagaaaaccatctccaaagccaaa<br>gggcagccccgagaaccacaggtgtacgtgctgcccccatcccgggaggagatgaccaagaaccaggtcagcct<br>gctgtgcctggtcaaaggcttctatcccagcgacatcgccgtggagtgggagagcaatgggcagccggagaacaa<br>ctacctcacctggcctcccgtgctggactccgacggctccttcttcctctacagcaagctcaccgtggacaagtccag<br>atggcagcaggggaacgtcttctcatgctccgtgatgcatgaggctctgcacaaccactacacgcagaagtctctctc<br>cctgtctccgggaaaa |
| MHG B689-HL-Fc | 657 | CAGGTACAGCTGCAGCAGTCAGGTCCAGGACTGGTGAAGCCCTCGCA<br>GACCCTCTCACTCACCTGTGTCATCTCCGGGGACAGTGTCTCTAGCAA<br>CAGAGCTGCCTGGAACTGGATCAGGCAGTCCCCATCGAGAGGCCTTG<br>AGTGGCTGGGAAGGACATACTACAGGTCCAAGTGGTATAATGATTAT<br>GCAGTTTCTGTGAAAAGTCGAATAACCATCAATTCAGACACATCCAAG<br>AACCAGATCTCCCTGCAGTTGAACTCTGTGACTCCCGAGGACACGGCT<br>GTGTATTACTGTGCAAGAGTGAGACCGGGGATCCCTTTTGACTACTGG<br>GGCCAGGGAACCACGGTCACCGTCTCCTCAGGCGGATCTGAGGGAAA<br>GTCCAGCGGCTCCGGCAGCGAAAGCAAGTCCACCGGCGGAAGCGACA<br>TCCAGATGACCCAGTCTCCAGACTCCCTGGCTGTGTCTCTGGGCGAGA<br>GGGCCACCATCAACTGCGAGTCCAGCCAGAGTGTTTTATTCAGCTCCA<br>ACAAAAAGAACTACTTAGCTTGGTACCAGCAGAAACCAGGACAGCCC<br>CCTAAGCTGCTCATTTACTGGGCATCTACCCGGGAATCCGGGGTCCCT<br>GACCGATTCAGTGGCAGCGGGTCTGGGACAGATTTCACTCTCACCATC<br>AACCGCCTGCAGGCTGAAGATGTGGCAGTTTATTACTGTCAGCAATAT<br>AATAGTACTCCGTGGACGTTCGGCCAAGGGACCAAGGTGGAGATCAA<br>Agagcccaaatctagcgacaaaactcacacttgtccaccgtgcccagcacctgaagcagcaggggggaccgtcag<br>tcttcctcttccccccaaaacccaaggacaccctcatgatctcccggacccctgaggtcacatgcgtggtggtgagc<br>gtgagccacgaagaccctgaggtcaagttcaactggtacgtggacggcgtggaggtgcataatgccaagacaaag<br>ccgcgggaggagcagtacaacagcacgtaccgtgtggtcagcgtcctcaccgtcctgcaccaggactggctgaat<br>ggcaaggagtacaagtgcaaggtgtccaacaaagccctcccagcccccatcgagaaaaccatctccaaagccaaa<br>gggcagccccgagaaccacaggtgtacgtgctgcccccatcccgggaggagatgaccaagaaccaggtcagcct<br>gctgtgcctggtcaaaggcttctatcccagcgacatcgccgtggagtgggagagcaatgggcagccggagaacaa<br>ctacctcacctggcctcccgtgctggactccgacggctccttcttcctctacagcaagctcaccgtggacaagtccag<br>atggcagcaggggaacgtcttctcatgctccgtgatgcatgaggctctgcacaaccactacacgcagaagtctctctc<br>cctgtctccgggaaaa |

TABLE 57-continued cDNA sequences of anti-HLA-G scFvs and scFv-Fcs.

| scFv or scFv-Fc | cDNA SEQ ID NO: | cDNA |
|---|---|---|
| MHG B689-LH-Fc | 658 | GACATCCAGATGACCCAGTCTCCAGACTCCCTGGCTGTGTCTCTGGGC<br>GAGAGGGCCACCATCAACTGCGAGTCCAGCCAGAGTGTTTTATTCAGC<br>TCCAACAAAAAGAACTACTTAGCTTGGTACCAGCAGAAACCAGGACA<br>GCCCCCTAAGCTGCTCATTTACTGGGCATCTACCCGGGAATCCGGGGT<br>CCCTGACCGATTCAGTGGCAGCGGGTCTGGGACAGATTTCACTCTCAC<br>CATCAACCGCCTGCAGGCTGAAGATGTGGCAGTTTATTACTGTCAGCA<br>ATATAATAGTACTCCGTGGACGTTCGGCCAAGGGACCAAGGTGGAGA<br>TCAAAGGCGGATCTGAGGGAAAGTCCAGCGGCTCCGGCAGCGAAAGC<br>AAGTCCACCGGCGGAAGCCAGGTACAGCTGCAGCAGTCAGGTCCAGG<br>ACTGGTGAAGCCCTCGCAGACCCTCTCACTCACCTGTGTCATCTCCGG<br>GGACAGTGTCTCTAGCAACAGAGCTGCCTGGAACTGGATCAGGCAGT<br>CCCCATCGAGAGGCCTTGAGTGGCTGGGAAGGACATACTACAGGTCC<br>AAGTGGTATAATGATTATGCAGTTTCTGTGAAAAGTCGAATAACCATC<br>AATTCAGACACATCCAAGAACCAGATCTCCCTGCAGTTGAACTCTGTG<br>ACTCCCGAGGACACGGCTGTGTATTACTGTGCAAGAGTGAGACCGGG<br>GATCCCTTTTGACTACTGGGGCCAGGGAACCACGGTCACCGTCTCCTC<br>Agagcccaaatctagcgacaaaactcacacttgtccaccgtgcccagcacctgaagcagcaggggggaccgtcag<br>tcttcctcttccccccaaaacccaaggacaccctcatgatctcccggacccctgaggtcacatgcgtggtggtgagc<br>gtgagccacgaagaccctgaggtcaagttcaactggtacgtggacggcgtggaggtgcataatgccaagacaaag<br>ccgcgggaggagcagtacaacagcacgtaccgtgtggtcagcgtcctcaccgtcctgcaccaggactggctgaat<br>ggcaaggagtacaagtgcaaggtgtccaacaaagccctcccagcccccatcgagaaaaccatctccaaagccaaa<br>gggcagccccgagaaccacaggtgtacgtgctgcccccatcccgggaggagatgaccaagaaccaggtcagcct<br>gctgtgcctggtcaaaggcttctatcccagcgacatcgccgtggagtgggagagcaatgggcagccggagaacaa<br>ctacctcacctggcctcccgtgctggactccgacggctccttcttcctctacagcaagctcaccgtggacaagtccag<br>atggcagcaggggaacgtcttctcatgctccgtgatgcatgaggctctgcacaaccactacacgcagaagtctctctc<br>cctgtctccgggaaaa |
| MHG B694-HL-Fc | 659 | GAGGTGCAGCTGTTGGAGTCTGGGGGAGGCTTGGTACAGCCTGGGGG<br>GTCCCTGAGACTCTCCTGTGCAGCCTCTGGATTCACCTTTAGCAGCTAT<br>GCCATGCACTGGGTCCGCCAGGCCCCAGGGAAGGGGCTGGACTGGGT<br>CTCAGGTATTAGTGGTAGTGGCTTTAGCACATACTATGTAGACTCCGT<br>GAAGGGCCGGTTCACCATCTCCAGAGACAATTCCAAGCACACGCTGT<br>ATCTGCAAATGAACAGCCTGAGAGCCGAGGACACGGCCGTATATTAC<br>TGTGCGAAAGATAATTTAGTGGCTGGTACCGTCTTTGACTACTGGGGC<br>CAGGGAACCCTGGTCACCGTCTCCTCAGGCGGATCTGAGGGAAAGTC<br>CAGCGGCTCCGGCAGCGAAAGCAAGTCCACCGGCGGAAGCGACATCC<br>AGATGACCCAGTCTCCTTCCACCCTGTCTGCATCTGTAGGAGACAGAG<br>TCACCATCACTTGCCGGGCCAGTCAGAGTATTAGTAGCTGGTTGGCCT<br>GGTATCAGCAGAAACCAGGGAAAGCCCCTAAGCTCCTGATCTATAAG<br>GCGTCTAGTTTAGAAAGTGGGGTCCCATCAAGGTTCAGCGGCAGTGG<br>ATCTGGGACAGAATTCACTCTCACCATCAGCAGCCTGCAGCCTGATGA<br>TTTTGCAACTTATTACTGCCAACAGTATAATAGTTATTCGCTCACTTTC<br>GGCGGAGGGACCAAGGTGGATATCAAAgagcccaaatctagcgacaaaactcacacttgt<br>ccaccgtgcccagcacctgaagcagcaggggggaccgtcagtcttcctcttccccccaaaacccaaggacaccctc<br>atgatctcccggacccctgaggtcacatgcgtggtggtgagcgtgagccacgaagaccctgaggtcaagttcaact<br>ggtacgtggacggcgtggaggtgcataatgccaagacaaagccgcgggaggagcagtacaacagcacgtaccgt<br>gtggtcagcgtcctcaccgtcctgcaccaggactggctgaatggcaaggagtacaagtgcaaggtgtccaacaaag<br>ccctcccagcccccatcgagaaaaccatctccaaagccaaagggcagccccgagaaccacaggtgtacgtgctgc<br>ccccatcccgggaggagatgaccaagaaccaggtcagcctgctgtgcctggtcaaaggcttctatcccagcgacat<br>cgccgtggagtgggagagcaatgggcagccggagaacaactacctcacctggcctcccgtgctggactccgacg<br>gctccttcttcctctacagcaagctcaccgtggacaagtccagatggcagcaggggaacgtcttctcatgctccgtga<br>tgcatgaggctctgcacaaccactacacgcagaagtctctctccctgtctccgggaaaa |
| MHG B694-LH-Fc | 660 | GACATCCAGATGACCCAGTCTCCTTCCACCCTGTCTGCATCTGTAGGA<br>GACAGAGTCACCATCACTTGCCGGGCCAGTCAGAGTATTAGTAGCTGG<br>TTGGCCTGGTATCAGCAGAAACCAGGGAAAGCCCCTAAGCTCCTGATC<br>TATAAGGCGTCTAGTTTAGAAAGTGGGGTCCCATCAAGGTTCAGCGGC<br>AGTGGATCTGGGACAGAATTCACTCTCACCATCAGCAGCCTGCAGCCT<br>GATGATTTTGCAACTTATTACTGCCAACAGTATAATAGTTATTCGCTCA<br>CTTTCGGCGGAGGGACCAAGGTGGATATCAAAGGCGGATCTGAGGGA<br>AAGTCCAGCGGCTCCGGCAGCGAAAGCAAGTCCACCGGCGGAAGCGA<br>GGTGCAGCTGTTGGAGTCTGGGGGAGGCTTGGTACAGCCTGGGGGGT<br>CCCTGAGACTCTCCTGTGCAGCCTCTGGATTCACCTTTAGCAGCTATGC<br>CATGCACTGGGTCCGCCAGGCCCCAGGGAAGGGGCTGGACTGGGTCT<br>CAGGTATTAGTGGTAGTGGCTTTAGCACATACTATGTAGACTCCGTGA<br>AGGGCCGGTTCACCATCTCCAGAGACAATTCCAAGCACACGCTGTATC<br>TGCAAATGAACAGCCTGAGAGCCGAGGACACGGCCGTATATTACTGT<br>GCGAAAGATAATTTAGTGGCTGGTACCGTCTTTGACTACTGGGGCCAG<br>GGAACCCTGGTCACCGTCTCCTCAgagcccaaatctagcgacaaaactcacacttgtccaccg<br>tgcccagcacctgaagcagcaggggggaccgtcagtcttcctcttccccccaaaacccaaggacaccctcatgatctc<br>ccggacccctgaggtcacatgcgtggtggtgagcgtgagccacgaagaccctgaggtcaagttcaactggtacgtg<br>gacggcgtggaggtgcataatgccaagacaaagccgcgggaggagcagtacaacagcacgtaccgtgtggtcag |

TABLE 57-continued

| cDNA sequences of anti-HLA-G scFvs and scFv-Fcs. | | |
|---|---|---|
| scFv or scFv-Fc | cDNA SEQ ID NO: | cDNA |
| | | cgtcctcaccgtcctgcaccaggactggctgaatggcaaggagtacaagtgcaaggtgtccaacaaagccctccca gcccccatcgagaaaaccatctccaaagccaaagggcagccccgagaaccacaggtgtacgtgctgcccccatcc cgggaggagatgaccaagaaccaggtcagcctgctgtgcctggtcaaaggcttctatcccagcgacatcgccgtg gagtgggagagcaatgggcagccggagaacaactacctcacctggcctcccgtgctggactccgacggctccttct tcctctacagcaagctcaccgtggacaagtccagatggcagcaggggaacgtcttctcatgctccgtgatgcatgag gctctgcacaaccactacacgcagaagtctctctccctgtctccgggaaaa |
| MHG B732-HL-Fc | 661 | CAAGTACAACTGCAACAAAGTGGTCCTGGGCTCGTGAAGCCTTCCCAG ACTCTCAGCCTCACATGCGCTATAAGTGGGGATTCTGTTTCCTCAAATT CAGCAGCCTGGAATTGGATACGACAGTCTCCATCCCGTGGCCTTGAGT GGCTTGGTAGAACTTATTACCGATCCAAGTGGTACAATGATTACGCCG TTTCAGTGAAGTCCCGCATTACTATTAATCCCGACACATCTAAGAATC AAATTTCATTGCAACTGAATAGCGTAACACCCGAAGATACAGCAGTTT ATTATTGTGCAGGTGATCGACGCTACGGCATAGTGGGACTTCCTTTCG CCTATTGGGGCCAAGGGACACTGGTCACTGTGTCATCCGGCGGATCTG AGGGAAAGTCCAGCGGCTCCGGCAGCGAAAGCAAGTCCACCGGCGGA AGCGACATCGTAATGACACAGTCACCAGATTCATTGGCAGTTAGTCTG GGTGAAAGGGCAACAATCAACTGCAAGTCTTCTCAGAGTGTACTGCAT AGTTCTAACAATAAGAACTACCTTACCTGGTTTCAACAGAAACCAGGT CAGCCCCCCAAGTTGCTGATTTACTGGGCAAGCACCCGCGAATCCGGC GTTCCCGATCGATTTTCAGGTTCCGGGAGTGGGACCGACTTTACCTTG ACCATCTCTTCCTTGCAGGCCGAAGATGTAGCCGTCTATTACTGCCAT CAGTATTACTCTACTCCCCCCACATTCGGTCAAGGTACAAAAGTTGAG ATAAAAgagcccaaatctagcgacaaaactcacacttgtccaccgtgcccagcacctgaagcagcaggggg accgtcagtcttcctcttccccccaaaacccaaggacaccctcatgatctcccggacccctgaggtcacatgcgtggt ggtgagcgtgagccacgaagaccctgaggtcaagttcaactggtacgtggacggcgtggaggtgcataatgccaa gacaaagccgcgggaggagcagtacaacagcacgtaccgtgtggtcagcgtcctcaccgtcctgcaccaggact ggctgaatggcaaggagtacaagtgcaaggtgtccaacaaagccctcccagcccccatcgagaaaaccatctcca aagccaaagggcagccccgagaaccacaggtgtacgtgctgcccccatcccgggaggagatgaccaagaacca ggtcagcctgctgtgcctggtcaaaggcttctatcccagcgacatcgccgtggagtgggagagcaatgggcagcc ggagaacaactacctcacctggcctcccgtgctggactccgacggctccttcttcctctacagcaagctcaccgtgg acaagtccagatggcagcaggggaacgtcttctcatgctccgtgatgcatgaggctctgcacaaccactacacgca gaagtctctctccctgtctccgggaaaa |
| MHG B732-LH-Fc | 662 | GACATCGTAATGACACAGTCACCAGATTCATTGGCAGTTAGTCTGGGT GAAAGGGCAACAATCAACTGCAAGTCTTCTCAGAGTGTACTGCATAGT TCTAACAATAAGAACTACCTTACCTGGTTTCAACAGAAACCAGGTCAG CCCCCCAAGTTGCTGATTTACTGGGCAAGCACCCGCGAATCCGGCGTT CCCGATCGATTTTCAGGTTCCGGGAGTGGGACCGACTTTACCTTGACC ATCTCTTCCTTGCAGGCCGAAGATGTAGCCGTCTATTACTGCCATCAG TATTACTCTACTCCCCCCACATTCGGTCAAGGTACAAAAGTTGAGATA AAAGGCGGATCTGAGGGAAAGTCCAGCGGCTCCGGCAGCGAAAGCAA GTCCACCGGCGGAAGCCAAGTACAACTGCAACAAAGTGGTCCTGGGC TCGTGAAGCCTTCCCAGACTCTCAGCCTCACATGCGCTATAAGTGGGG ATTCTGTTTCCTCAAATTCAGCAGCCTGGAATTGGATACGACAGTCTC CATCCCGTGGCCTTGAGTGGCTTGGTAGAACTTATTACCGATCCAAGT GGTACAATGATTACGCCGTTTCAGTGAAGTCCCGCATTACTATTAATC CCGACACATCTAAGAATCAAATTTCATTGCAACTGAATAGCGTAACAC CCGAAGATACAGCAGTTTATTATTGTGCAGGTGATCGACGCTACGGCA TAGTGGGACTTCCTTTCGCCTATTGGGGCCAAGGGACACTGGTCACTG TGTCATCCgagcccaaatctagcgacaaaactcacacttgtccaccgtgcccagcacctgaagcagcaggg ggaccgtcagtcttcctcttccccccaaaacccaaggacaccctcatgatctcccggacccctgaggtcacatgcgt ggtggtgagcgtgagccacgaagaccctgaggtcaagttcaactggtacgtggacggcgtggaggtgcataatgc caagacaaagccgcgggaggagcagtacaacagcacgtaccgtgtggtcagcgtcctcaccgtcctgcaccagg actggctgaatggcaaggagtacaagtgcaaggtgtccaacaaagccctcccagcccccatcgagaaaaccatctc caaagccaaagggcagccccgagaaccacaggtgtacgtgctgcccccatcccgggaggagatgaccaagaac caggtcagcctgctgtgcctggtcaaaggcttctatcccagcgacatcgccgtggagtgggagagcaatgggcagc cggagaacaactacctcacctggcctcccgtgctggactccgacggctccttcttcctctacagcaagctcaccgtg gacaagtccagatggcagcaggggaacgtcttctcatgctccgtgatgcatgaggctctgcacaaccactacacgc agaagtctctctccctgtctccgggaaaa |
| MHG B737-HL-Fc | 663 | GAGGTGCAACTCCTTGAATCAGGCGGAGGACTCGTCCAACCTGGAGG GAGTCTTAGGCTTAGCTGTGCAGCCAGTGGCTTTACTTTTAGCAGCTA TGCAATGCACTGGGTCAGGCAGGCTCCTGGTAAGGGGCTCGAATGGG TCAGCGGCATATCCGGGTCAGGTTTCTCTACATATTATGTCGATTCTGT AAAAGGACGATTCACCATATCCAGAGACAATTCTAAAAATACCTTGTA TCTCCAGATGAACAGCCTGAGAGCAGAAGATACCGCAGTTTATTACTG TGCAAAGGATAATCTGGTTGCCGGGACAGTTTTTGATTATTGGGGGCA AGGCACCCTCGTCACAGTATCCAGTGGCGGATCTGAGGGAAAGTCCA GCGGCTCCGGCAGCGAAAGCAAGTCCACCGGCGGAAGCGATATTCAG ATGACTCAATCACCTTCAACCCTTAGCGCCTCCGTTGGAGATCGCGTT ACCATTACCTGCCGAGCCTCCCAAAGTATCAGCTCATGGTTGGCATGG TATCAACAGAAGCCTGGAAAGGCACCCAAACTTCTGATTTACAAAGC |

TABLE 57-continued cDNA sequences of anti-HLA-G scFvs and scFv-Fcs.

| scFv or scFv-Fc | cDNA SEQ ID NO: | cDNA |
|---|---|---|
| | | CAGCTCCTTGGAGTCAGGAGTCCCAAGCCGGTTCAGCGGATCTGGGTC<br>AGGGACAGAATTTACCCTGACCATATCTTCCCTTCAGCCCGACGACTT<br>CGCCACTTACTATTGTCAGCAATACAACTCCTATTCCCTGACTTTCGGC<br>GGTGGCACAAAGGTTGACATCAAGgagcccaaatctagcgacaaaactcacacttgtccacc<br>gtgcccagcacctgaagcagcaggggggaccgtcagtcttcctcttccccccaaaacccaaggacaccctcatgatc<br>tcccggacccctgaggtcacatgcgtggtggtgagcgtgagccacgaagaccctgaggtcaagttcaactggtacg<br>tggacggcgtggaggtgcataatgccaagacaaagccgcgggaggagcagtacaacagcacgtaccgtgtggtc<br>agcgtcctcaccgtcctgcaccaggactggctgaatggcaaggagtacaagtgcaaggtgtccaacaaagccctcc<br>cagcccccatcgagaaaaccatctccaaagccaaagggcagccccgagaaccacaggtgtacgtgctgcccccat<br>cccgggaggagatgaccaagaaccaggtcagcctgctgtgcctggtcaaaggcttctatcccagcgacatcgccgt<br>ggagtgggagagcaatgggcagccggagaacaactacctcacctggcctcccgtgctggactccgacggctcctt<br>cttcctctacagcaagctcaccgtggacaagtccagatggcagcaggggaacgtcttctcatgctccgtgatgcatg<br>aggctctgcacaaccactacacgcagaagtctctctccctgtctccgggaaaa |
| MHG B737-LH-Fc | 664 | GATATTCAGATGACTCAATCACCTTCAACCCTTAGCGCCTCCGTTGGA<br>GATCGCGTTACCATTACCTGCCGAGCCTCCCAAAGTATCAGCTCATGG<br>TTGGCATGGTATCAACAGAAGCCTGGAAAGGCACCCAAACTTCTGATT<br>TACAAAGCCAGCTCCTTGGAGTCAGGAGTCCCAAGCCGGTTCAGCGG<br>ATCTGGGTCAGGGACAGAATTTACCCTGACCATATCTTCCCTTCAGCC<br>CGACGACTTCGCCACTTACTATTGTCAGCAATACAACTCCTATTCCCTG<br>ACTTTCGGCGGTGGCACAAAGGTTGACATCAAGGGCGGATCTGAGGG<br>AAAGTCCAGCGGCTCCGGCAGCGAAAGCAAGTCCACCGGCGGAAGCG<br>AGGTGCAACTCCTTGAATCAGGCGGAGGACTCGTCCAACCTGGAGGG<br>AGTCTTAGGCTTAGCTGTGCAGCCAGTGGCTTTACTTTTAGCAGCTAT<br>GCAATGCACTGGGTCAGGCAGGCTCCTGGTAAGGGGCTCGAATGGGT<br>CAGCGGCATATCCGGGTCAGGTTTCTCTACATATTATGTCGATTCTGTA<br>AAAGGACGATTCACCATATCCAGAGACAATTCTAAAAATACCTTGTAT<br>CTCCAGATGAACAGCCTGAGAGCAGAAGATACCGCAGTTTATTACTGT<br>GCAAAGGATAATCTGGTTGCCGGGACAGTTTTTGATTATTGGGGGCAA<br>GGCACCCTCGTCACAGTATCCAGTgagcccaaatctagcgacaaaactcacacttgtccacc<br>gtgcccagcacctgaagcagcaggggggaccgtcagtcttcctcttccccccaaaacccaaggacaccctcatgatc<br>tcccggacccctgaggtcacatgcgtggtggtgagcgtgagccacgaagaccctgaggtcaagttcaactggtacg<br>tggacggcgtggaggtgcataatgccaagacaaagccgcgggaggagcagtacaacagcacgtaccgtgtggtc<br>agcgtcctcaccgtcctgcaccaggactggctgaatggcaaggagtacaagtgcaaggtgtccaacaaagccctcc<br>cagcccccatcgagaaaaccatctccaaagccaaagggcagccccgagaaccacaggtgtacgtgctgcccccat<br>cccgggaggagatgaccaagaaccaggtcagcctgctgtgcctggtcaaaggcttctatcccagcgacatcgccgt<br>ggagtgggagagcaatgggcagccggagaacaactacctcacctggcctcccgtgctggactccgacggctcctt<br>cttcctctacagcaagctcaccgtggacaagtccagatggcagcaggggaacgtcttctcatgctccgtgatgcatg<br>aggctctgcacaaccactacacgcagaagtctctctccctgtctccgggaaaa |
| MHG B738-HL-Fc | 665 | CAGGTGCAGCTTCAACAGAGCGGACCTGGTCTGGTTAAGCCTTCCCAA<br>ACCCTGAGCCTGACTTGTGCTATTTCCGGGGATAGTGTTAGCTCCAAT<br>AGGGCAGCATGGAACTGGATCAGACAGTCCCCAAGCCGTGGACTTGA<br>GTGGCTTGGACGTACTTATTACAGGAGTAAATGGTACAATGATTATGC<br>CGTTTCTGTGAAGAGCCGTATTACTATAAACCCAGATACTTCTAAAAA<br>TCAAATTTCCCTTCAGCTCAACTCAGTTACACCAGAGGATACTGCAGT<br>CTATTATTGCGCAAGAGTTCGACCTGGCATTCCCTTCGATTATTGGGG<br>GCAGGGGACACCCGTTACTGTGTCCTCAGGCGGATCTGAGGGAAAGT<br>CCAGCGGCTCCGGCAGCGAAAGCAAGTCCACCGGCGGAAGCGATATT<br>GTTATGACACAGTCCCCAGATTCATTGGCAGTAAGCCTCGGTGAACGG<br>GCTACTATTAACTGTAAGTCTTCCCAGAGTGTATTGTTCTCTTCAAATA<br>ACAAAAACTACCTGGCATGGTATCAGCAAAAGCCTGGTCAACCCCCT<br>AAACTTCTCATATACTGGGCATCCACTCGGGAGAGCGGTGTGCCAGAC<br>CGTTTCTCAGGGAGTGTGTCAGGTACAGATTTTACACTCACAATTTCC<br>AGCCTCCAAGCCGAAGACGTTGCAGTATATTATTGCCAACAATATCAC<br>TCTACACCTTGGACATTTGGTCAAGGTACTAAAGTCGAAATCAAAgagc<br>ccaaatctagcgacaaaactcacacttgtccaccgtgcccagcacctgaagcagcaggggggaccgtcagtcttcct<br>cttccccccaaaacccaaggacaccctcatgatctcccggacccctgaggtcacatgcgtggtggtgagcgtgagc<br>cacgaagaccctgaggtcaagttcaactggtacgtggacggcgtggaggtgcataatgccaagacaaagccgcgg<br>gaggagcagtacaacagcacgtaccgtgtggtcagcgtcctcaccgtcctgcaccaggactggctgaatggcaag<br>gagtacaagtgcaaggtgtccaacaaagccctcccagcccccatcgagaaaaccatctccaaagccaaagggcag<br>ccccgagaaccacaggtgtacgtgctgcccccatcccgggaggagatgaccaagaaccaggtcagcctgctgtgc<br>ctggtcaaaggcttctatcccagcgacatcgccgtggagtgggagagcaatgggcagccggagaacaactacctc<br>acctggcctcccgtgctggactccgacggctccttcttcctctacagcaagctcaccgtggacaagtccagatggca<br>gcaggggaacgtcttctcatgctccgtgatgcatgaggctctgcacaaccactacacgcagaagtctctctccctgtc<br>tccgggaaaa |
| MHG B738-LH-Fc | 666 | GATATTGTTATGACACAGTCCCCAGATTCATTGGCAGTAAGCCTCGGT<br>GAACGGGCTACTATTAACTGTAAGTCTTCCCAGAGTGTATTGTTCTCTT<br>CAAATAACAAAAACTACCTGGCATGGTATCAGCAAAAGCCTGGTCAA<br>CCCCCTAAACTTCTCATATACTGGGCATCCACTCGGGAGAGCGGTGTG<br>CCAGACCGTTTCTCAGGGAGTGTGTCAGGTACAGATTTTACACTCACA<br>ATTTCCAGCCTCCAAGCCGAAGACGTTGCAGTATATTATTGCCAACAA |

TABLE 57-continued

| cDNA sequences of anti-HLA-G scFvs and scFv-Fcs. | | |
|---|---|---|
| scFv or scFv-Fc | cDNA SEQ ID NO: | cDNA |
| | | TATCACTCTACACCTTGGACATTTGGTCAAGGTACTAAAGTCGAAATC AAAGGCGGATCTGAGGGAAAGTCCAGCGGCTCCGGCAGCGAAAGCAA GTCCACCGGCGGAAGCCAGGTGCAGCTTCAACAGAGCGGACCTGGTC TGGTTAAGCCTTCCCAAACCCTGAGCCTGACTTGTGCTATTTCCGGGG ATAGTGTTAGCTCCAATAGGGCAGCATGGAACTGGATCAGACAGTCC CCAAGCCGTGGACTTGAGTGGCTTGGACGTACTTATTACAGGAGTAAA TGGTACAATGATTATGCCGTTTCTGTGAAGAGCCGTATTACTATAAAC CCAGATACTTCTAAAAATCAAATTTCCCTTCAGCTCAACTCAGTTACA CCAGAGGATACTGCAGTCTATTATTGCGCAAGAGTTCGACCTGGCATT CCCTTCGATTATTGGGGGCAGGGGACACCCGTTACTGTGTCCTCAgagcc caaatctagcgacaaaactcacacttgtccaccgtgcccagcacctgaagcagcagggggaccgtcagtcttcctct tcccccaaaacccaaggacaccctcatgatctcccggacccctgaggtcacatgcgtggtggtgagcgtgagcca cgaagaccctgaggtcaagttcaactggtacgtggacggcgtggaggtgcataatgccaagacaaagccgcggg aggagcagtacaacagcacgtaccgtgtggtcagcgtcctcaccgtcctgcaccaggactggctgaatggcaagg agtacaagtgcaaggtgtccaacaaagccctcccagcccccatcgagaaaaccatctccaaagccaaagggcagc cccgagaaccacaggtgtacgtgctgcccccatcccgggaggagatgaccaagaaccaggtcagcctgctgtgcc tggtcaaaggcttctatcccagcgacatcgccgtggagtgggagagcaatgggcagccggagaacaactacctca cctggcctcccgtgctggactccgacggctccttcttcctctacagcaagctcaccgtggacaagtccagatggcag caggggaacgtcttctcatgctccgtgatgcatgaggctctgcacaaccactacacgcagaagtctctctccctgtctc cgggaaaa |

Example 9. Biophysical Characterization of Ani-HLA-G Antibodies

Thermal Stability of Ani-HLA-G Antibodies.

The original and germline-optimized v-regions were screened for thermal stability in scFv format. Briefly, v-regions were cloned into scFv format and were expressed in *E. coli*. The culture supernatants were assessed by ELISA for their abilities to bind recombinant HLA-G. Supernatant samples were also heat shocked at either 55, 60, or 65° C., and the binding of the heat-shocked samples was compared to the unheated samples. This analysis provided an estimate of the thermal stability of the v-regions when formatted as scFv. Based on this analysis, MHGB737 and MHGB738, the germline-optimized versions of MHGB694 and MHGB688, respectively, were preferred.

FIG. 12 and Table 58 show the ability of v-regions to bind recombinant HLA-G after heat treatment when formatted as scFv. V-regions were expressed as scFv in the supernatant from *E. coli* and were analyzed for their ability to bind recombinant HLA-G by ELISA. Samples were tested at room temperature or after heat treatment for 10 min at 55, 60, or 65° C. B23 was an isotype control.

TABLE 58

| Analysis of antigen binding after heat treatment by v-regions formatted as scFv. | | | | |
|---|---|---|---|---|
| Antibody parent of | Room temperature binding | % Binding retained | | |
| scFv | signal | 55° C. | 60° C. | 65° C. |
| MHGB665 | 15215600 | 103 | 122 | 11 |
| MHGB668 | | No binding | | |
| MHGB669 | | No binding | | |
| MHGB672 | | No binding | | |
| MHGB687 | | No binding | | |
| MHGB688 | | No binding | | |
| MHGB689 | 3073733 | 2 | 3 | 4 |
| MHGB694 | 3073733 | 85 | 9 | 4 |
| MHGB737 (GL optimized B694) | 2747333 | 84 | 80 | 48 |
| MHGB738 (GL optimized B688) | 5758400 | 14 | 2 | 1 |

Binding Specificity and Affinity

The v-regions in IgG1 mAb format were tested for their abilities to specifically bind cells expressing HLA-G but not other MHC class I molecules (Table 59). Briefly, $1.5\times10^7$ cells were washed 2 times with 1×PBS and resuspended in 7 mL of 1×PBS and incubated for 10 min. After incubation, 8 mL of fetal bovine serum (FBS) were added, cells were washed by centrifugation at 300×g for 5 min and resuspended at $1\times10^6$ cells/mL in DMEM supplemented with 10% FBS. Cells were then washed by centrifugation at 300×g for 5 min and resuspended in staining buffer supplemented with goat anti-human Fc A647 (Jackson cat. #109-606-098) and incubated for 30 min at 4° C. After incubation, 150 μL of staining buffer were added and cells were washed by centrifugation at 300×g for 5 min. Cells were resuspended in 200 μL of running buffer (staining buffer supplemented with 1 mM EDTA, 0.1% (v/v) pluronic acid) and washed by centrifugation at 300×g for 5 min. Cells were resuspended in 30 mL of running buffer and analyzed for antibody binding by flow cytometry.

TABLE 59

Cell-based selectivity of anti-HLA-G antibodies. Geomean fluorescence signal reports maximum value for binding.

| Antibody | HLA-G | HLA-A | HLA-B | HLA-C |
|---|---|---|---|---|
| MHGB665 GeoMean | 631628 | 9956 | 10436 | 11586 |
| MHGB668 GeoMean | 590753 | 4574 | 6323 | 4941 |
| MHGB669 GeoMean | 616340 | 8142 | 8312 | 10950 |
| MHGB672 GeoMean | 522292 | 158 | 4263 | 2447 |
| MHGB687 GeoMean | 527964 | 28765 | 22936 | 35939 |
| MHGB688 GeoMean | 481619 | 2860 | 6290 | 2226 |
| MHGB689 GeoMean | 536504 | 2541 | 5787 | 266 |
| MHGB694 GeoMean | 472613 | 2874 | 4853 | 3974 |

Next, the v-regions were tested for their abilities to bind recombinant HLA-G as mAbs using surface plasmon resonance (SPR). SPR is a label-free technique to study the strength of an interaction between two binding partners by measuring the change in mass upon complex formation and dissociation. Briefly, antibodies were immobilized on a sensor chip, which was coupled with goat anti-human Fc. Soluble HLA-G1 extracellular domain (MHGW8) was flowed over the immobilized antibody and association/dissociation responses were monitored. Kinetic information (on-rate and off-rate constants) were extracted by fitting sensorgrams to the 1:1 Langmuir model. Binding affinity ($K_D$) were reported as the ratio of rate constants ($k_{off}/k_{on}$). Antibody affinities ($K_d$) ranged from ~77 pM—2.6 nM and are shown in Table 60.

TABLE 60

SPR-based affinity measurements of variable regions binding to HLA-G (MHGW8).

| Antibody | ka (1/Ms) | kd (1/s) | KD (M) |
|---|---|---|---|
| MHGB665/MHGB732 | 5.18E+05 | 4.00E−05 | 7.71E−11 |
| MHGB669 | 3.15E+05 | 4.53E−04 | 1.44E−09 |
| MHGB672 | 3.25E+06 | 1.79E−03 | 5.50E−10 |
| MHGB687 | 1.89E+05 | 1.53E−04 | 8.09E−10 |
| MHGB688 | 6.58E+05 | 2.63E−04 | 4.00E−10 |
| MHGB694 | 2.08E+06 | 2.40E−03 | 1.15E−09 |
| MHGB737 | 1.996E+5 | 3.103E−4 | 2.555E−9 |
| MHGB738 | 2.03E+10 | 2.83E+00 | 1.39E−10 |

Example 10. Ligand Blocking

HLA-G is over-expressed on certain tumor types and can thus serve as a marker for tumor cells. Additionally, HLA-G binds to the ligands ILT2 and ILT4, which are expressed on immune effector cells such as NK cells[4,5]. The interaction between HLA-G and ILT2/ILT4 leads to inhibition of NK cell activity. Thus, we hypothesized that antibodies which bind to HLA-G competitively with ILT2/4 would prevent inhibitory interaction between tumor cells and NK cells and lead to increased NK mediated tumor cell killing. To address this hypothesis, we first assayed whether the antibodies could block interaction between HLA-G and ILT2/4 using a competition assay. Binding between the HLA-G-dextramer complex and HEK293T cells exogenously expressing ILT2 or ILT4 receptors results in a fluorescence signal. Addition of a mAb which competes with the interaction between HLA-G-dextramer and ILT-2/4 cells results in a decrease in fluorescence signal. The inverse of the fluorescence signal inhibition was related to the ligand blocking inhibition of the mAbs (Table 60). Briefly, recombinant biotinylated HLA-G1 (MHGW8) was bound up to a streptavidin APC-dextramer (Immudex cat. #DX01-APC) to a final ratio of approximately 4 HLA-G1 proteins per dextramer molecule. Dextramer-HLA-G complex was mixed with HEK293T cells exogenously expressing ILT-2 or cells exogenously expressing ILT-4 and incubated for 30 min. at 4° C. Anti-HLA-G antibody was added at each concentration and incubated with dextramer-HLA-G complex for 30 min at 4° C. Cells were added (25,000 cells) and incubated for 30 min at 4° C. After incubation, the mixture of cells and dextramer HLA-G complex were washed by centrifugation resuspended in 30 μL of running buffer (Thermo BD cat. #554657). The resuspended mixture was analyzed for fluorescence signal by flow cytometry using an Intellicyt® iQue® Screener Plus. Gating was done first on singlet cells, then live cells using Sytox™ Blue Dead Cell stain (ThermoFisher), then on GFP for cells expressing ILT-2/4, then on APC for bound dextramer-HLA-G complex. All antibodies except MHGB737 could inhibit HLA-G interaction with ILT4, and all antibodies except MHGB737 and MHGB687 could inhibit interaction with ILT2 (Table 61). This suggested that antibodies discovered in this campaign could both target tumors and relieve immune inhibition by the tumor cells.

TABLE 61

Ligand blocking properties of antibodies

| Antibody | ILT2 EC50 (nM) | ILT4 EC50 (nM) |
|---|---|---|
| MHGB665 | 1616.9 | 1742.7 |
| MHGB669 | 1700.7 | 1588.5 |
| MHGB672 | 2119.2 | 1612.8 |
| MHGB687 | NA | 1864.0 |
| MHGB688 | 1722.8 | 1420.8 |
| MHGB694 | 644.5 | 200.1 |
| MHGB732 | 1.8 | 2.0 |
| MHGB737 | NA | NA |
| MHGB738 | 1.6 | 1.6 |

Example 11. Epitope Mapping

We then asked whether this inhibition of ligand binding was due to direct competition with ILT2/4 for the same binding site on HLA-G. To address this hypothesis, we used hydrogen-deuterium exchange-based LC-MS (described in Example 9) to identify the epitopes on HLA-G for either ILT-2, ILT-4, MHGB732, or MHGB738 (FIG. 13). Binding of both MHGB732 and MHGB738 Abs strongly protected the same peptide in the α3 domain (amino acid residues 191-198 of the mature protein, sequence HHPVFDYE (SEQ ID NO: 667)), resulting in average change in deuteration levels >30%. This peptide was also protected in the presence of ILT2 and to a lesser extent in the presence of ILT4. Both MHGB732 and MHGB738 antibodies also significantly protected (average change in deuteration levels 10%-30%) a second epitope comprised of residues 249-251 of the mature protein, sequence VPS. The epitopes were mapped onto the crystal structure of HLA-G (PDB ID 1YDP)[6], which showed that the epitope for the MHGB732 and MHGB738 Abs and for ILT2/4 resided in the membrane-proximal region of the α3 domain.

Example 12. Effect on NK Cell-Based Cytotoxicity

We then asked whether inhibition of the interaction with HLA-G with ILT-2/4 could mediate anti-tumor activity via NK cell-based cytotoxicity. To address this, we cloned each variable region onto either an IgG1 or a silent IgG4-PAA constant region which lacks effector function. We then tested the ability of each antibody to mediate cytotoxicity of K562-HLA-G cells mediated by NK cells which either express Fc receptors (NK-92) or which lack Fc receptors (NKL). Briefly, K562 cells overexpressing HLA-G cells were labeled with Carboxyfluorescein succinimidyl ester (CFSE) which served as a cell proliferation dye. Antibodies were diluted into a 96-well plate according to the dilutions in FIG. 14A-19B. K562-HLA-G cells were added to each well of antibody and incubated for 1 hr at 4° C. NKL cells were added at approximately 100,000 cells/well, and the mixture was incubated in the presence of IL2 and NKp46 (to activate NKL cells) overnight (NKL cells) or 4 hr (NK-92 cells) at 4° C. Cells were washed by centrifugation and resuspended in buffer with live/dead stain. The mixture was resuspended in 130 μL of staining buffer and analyzed by flow cytometry using a FACS Fortessa cytometer. Antibodies which could mediate cytotoxicity in the absence of NK receptors were thought to mediate this interaction via blocking the immune checkpoint interaction between HLA-G and ILT-2/4 (FIG. 14A-19B). We found that all antibodies which could block ILT2 (all Abs except MHGB687) could enhance NKL cell-mediated cytotoxicity against K562-HLA-G cells in a 24 hr assay (FIGS. 14A, 15A, 16A, 17A, 18A, 19A) whereas only IgG1-based antibodies could enhance Fc-receptor mediated cytoxicity. This suggested that ligand blocking could serve as an important anti-tumor mechanism, even in the absence of Fc receptor mediated effector function.

Example 13. Effector Functions of mAbs

We tested the ability of antibodies to further mediate tumor cell killing via antibody-dependent cellular cytotoxicity (ADCC) against the choriocarcinoma cell line JEG-3 (ATCC® HTB-36) with endogenously expresses HLA-G (FIG. 20). Antibodies were added to JEG-3 cells labeled with BATDA dye (Perkin Elmer cat. #C136-100) which can unidirectionally penetrate into the cells. Upon cell lysis, the dye is released into the solution containing Europium which reacts with the dye to form a fluorescent chelate, whose fluorescence signal can be measured. PBMCs cultured overnight were added at an E: T ratio of 50:1 to JEG-3 cells at 5,000 cells/well and the mixture was incubated for 4 hr at 37° C. The cell mixture was added at 1:10 into Europium solution, incubated for 15 min at room temperature and fluorescence 610 nm was monitored to determine signal. The fluorescence signal for 100% killing was determined using a well containing BADTA-labeled target cells mixed with Triton™ I X-100 detergent.

Since the anti-HLA-G Abs could display ADCC in vitro, we asked whether this activity could be enhanced. Several studies showed that antibodies having less than 10% terminal fucosylated Fc display enhanced effector function due to higher affinity binding to Fc receptors 7. Thus, we generated MHGB732 and MHGB738 in a low fucose CHO host to produce an antibody with <10% terminal fucose (MHGB738.CLF) (Table 62, FIG. 21A-D). As a negative control, we generated a version of MHGB738 with an Fc region that could not bind Fc receptors, and this protein was called MHGB745.

The normal fucose and low fucose antibodies were tested for their abilities to induce NK cell-based ADCC against either JEG-3 cells (FIG. 21A) or against RERF-LC-Ad-1 cells (human lung adenocarcinoma cell line, JCRB1020) (FIG. 21B). Low fucose antibodies were generated by expression of the constructs encoding the heavy chain and light chain in CHO cells which natively express the fucosyltransferase enzyme at low levels, leading to production of antibodies have less than 10% core fucose. The ratio of effector cells to target cells is shown in the graph. The assay was performed in the same way as the ADCC assay described above. Both MHGB745 and the isotype control did not induce ADCC in the assay. The two IgG1 Abs, MHGB732 and MHGB738 could induce ADCC while the same antibodies having low fucose Fc regions displayed ~10-fold enhanced ADCC activity. This showed that ADCC enhancement could be obtained by use of a low fucose antibody.

We next tested the abilities of the antibodies to mediate complement-dependent cytotoxicity (CDC) (FIGS. 21C and 21D). Briefly, assays were run in 10% FBS containing DMEM (JEG-3) or RPMI (RERF-LC-Ad-1). Antibodies were added to target cells and incubated for 30 minutes at 37° C. After incubation, 15-20% (stock concentration) of rabbit complement (Cedarlane cat. #CL3441-S) and heat inactivated complement was added to the wells respectively in a volume of 25 μl/well. The mixture was incubated for 4-12 hours at 37° C. Target cell lysis was detected by addition of 100 μl of CellTitre-Glo (Promega cat. #G9242) reagent followed by incubation for 10 minutes at room temperature. Luminescence was monitored using a Tecan Microplate reader SPARK®. The two IgG1 antibodies, MHGB732 and MHGB738 did not mediate CDC. Since the IgG1 Abs could not mediate CDC, we cloned the v-regions into an IgG1 Fc harboring the K248E, T437R (RE) mutations which were shown to specifically enhance CDC activity [8]. These Abs, having the identical v-regions as their IgG1 counterparts, could mediate CDC activity. We asked whether the RE Fc variant would impact ADCC activity enhancement in the low fucose Abs and whether the low fucose Fc would impact CDC activity of the RE Fc variants. The RE Abs produced in a low fucose host (having <10% fucosylated Fc), MHGB752 and MHGB758 had identical ADCC activity to the low fucose IgG1 Abs MHGB732 and MHGB738 (FIGS. 21A and 21B). Analogously, the RE Abs produced in a low fucose host had identical CDC activity to the RE Abs produced in a normal fucose host (FIGS. 21C and 21D).

TABLE 62

Description of variants of MHGB738 having modified constant regions.

| Protein Name | Description |
|---|---|
| MHGB732 | IgG1 |
| MHGB738 | IgG1 |
| MHGB745 | L234A, L235A, D265S |
| MHGB752 | IgG1, K248E, T437R (RE) |
| MHGB758 | IgG1, K248E, T437R (RE) |

TABLE 62-continued

| Description of variants of MHGB738 having modified constant regions. | |
|---|---|
| Protein Name | Description |
| MHGB732.CLF | IgG1, low fucose |
| MHGB738.CLF | IgG1, low fucose |
| MHGB758.CLF | IgG1, K248E, T437R (RE), low fucose |
| MHGB758.CLF | IgG1, K248E, T437R (RE), low fucose |

Example 14: Generation of Bispecific HLA-G×CD3 Antibodies

The VH/VL regions of the anti-HLA-G antibodies generated in Examples 7-13 and the VH/VL regions of the anti-CD3 antibody of Example 1 were engineered into bispecific format and expressed as IgG1.

Engineering of CD3 scFv-Fcs and CD3 Fabs for HLA-G×CD3 Bispecific Generation.

The CD3-specific scFvs, scFv-Fcs, and Fab-Fcs were generated as described in Example 3. Additionally, the CD3-specific scFvs, scFv-Fcs, and Fab-Fcs were generated using VH/VL regions from CD3B450, that has been describe in US20200048349, and CD3B219, derived from SP34-2 antibody (BD Biosciences 551916). Null-scFv-Fc and B23B62-Fab-Fc were used as negative controls.

```
CD3B450-LH-scFv-Fc (SEQ ID NO: 684):
QSALTQPASVSGSPGQSITISCTGTSSNIGTYKFVSWYQQHPGKAPKVMIYEVSKRPSGVSNRFSG

SKSGNTASLTISGLQAEDEADYYCVSYAGSGTLLFGGGTKLTVLGGSEGKSSGSGSESKSTGGSQ

VQLQQSGPGLVKPSQTLSLTCAISGDSVFNNNAAWSWIRQSPSRGLEWLGRTYYRSKWLYDYA

VSVKSRITINPDTSKNQFSLQLNSVTPEDTAVYYCARGYSSSFDYWGQGTLVTVSSEPKSSDKTH

TCPPCPAPEAAGGPSVFLFPPKPKDTLMISRTPEVTCVVVSVSHEDPEVKFNWYVDGVEVHNAK

TKPREEQYNSTYRVVSVLTVLHQDWLNGKEYKCKVSNKALPAPIEKTISKAKGQPREPQVYVYP

PSREEMTKNQVSLTCLVKGFYPSDIAVEWESNGQPENNYKTTPPVLDSDGSFALVSKLTVDKSR

WQQGNVFSCSVMHEALHNHYTQKSLSLSPG

CD3B219-LH-scFv-Fc (SEQ ID NO: 685):
QTVVTQEPSLTVSPGGTVTLTCRSSTGAVTTSNYANWVQQKPGQAPRGLIGGTNKRAPGTPARF

SGSLLGGKAALTLSGVQPEDEAEYYCALWYSNLWVFGGGTKLTVLGGSEGKSSGSGSESKSTG

GSEVQLVESGGGLVQPGGSLRLSCAASGFTFNTYAMNWVRQAPGKGLEWVARIRSKYNNYAT

YYAASVKGRFTISRDDSKNSLYLQMNSLKTEDTAVYYCVRHGNFGNSYVSWFAYWGQGTLVT

VSSEPKSSDKTHTCPPCPAPEAAGGPSVFLFPPKPKDTLMISRTPEVTCVVVSVSHEDPEVKFNWY

VDGVEVHNAKTKPREEQYNSTYRVVSVLTVLHQDWLNGKEYKCKVSNKALPAPIEKTISKAKG

QPREPQVYVYPPSREEMTKNQVSLTCLVKGFYPSDIAVEWESNGQPENNYKTTPPVLDSDGSFA

LVSKLTVDKSRWQQGNVFSCSVMHEALHNHYTQKSLSLSPG

Null-scFv-Fc (SEQ ID NO: 686):
DIQMTQSPSSLSASVGDRVTITCRASQSISSYLNWYQQKPGCAPKLLIYAASSLQSGVPSRFSGSG

SGTDFTLTISSLQPEDFATYYCQQSYSTPLTFGQGTKVEIKGGGSGGSGGCPPCGGSGGEVQLLES

GGGLVQPGGSLRLSCAASGFTFSSYAMSWVRQAPGKGLEWVSAISGSGGSTYYADSVKGRFTIS

RDNSKNTLYLQMNSLRAEDTAVYYCAKYDGIYGELDFWGCGTLVTVSSEPKSSDKTHTCPPCPA

PEAAGGPSVFLFPPKPKDTLMISRTPEVTCVVVSVSHEDPEVKFNWYVDGVEVHNAKTKPREEQ

YNSTYRVVSVLTVLHQDWLNGKEYKCKVSNKALPAPIEKTISKAKGQPREPQVYVYPPSREEMT

KNQVSLTCLVKGFYPSDIAVEWESNGQPENNYKTTPPVLDSDGSFALVSKLTVDKSRWQQGNVF

SCSVMHEALHNHYTQKSLSLSPG

B23B62-Fab-Fc arm heavy chain (SEQ ID NO: 687):
QITLKESGPTLVKPTQTLTLTCTFSGFSLSTSGMGVSWIRQPPGKALEWLAHIYWDDDKRYNPSL

KSRLTITKDTSKNQVVLTMTNMDPVDTATYYCARLYGFTYGFAYWGQGTLVTVSSASTKGPSV

FPLAPSSKSTSGGTAALGCLVKDYFPEPVTVSWNSGALTSGVHTFPAVLQSSGLYSLSSVVTVPSS

SLGTQTYICNVNHKPSNTKVDKKVEPKSCDKTHTCPPCPAPEAAGGPSVFLFPPKPKDTLMISRTP

EVTCVVVSVSHEDPEVKFNWYVDGVEVHNAKTKPREEQYNSTYRVVSVLTVLHQDWLNGKEY
```

-continued

KCKVSNKALPAPIEKTISKAKGQPREPQVYVYPPSREEMTKNQVSLTCLVKGFYPSDIAVEWESN

GQPENNYKTTPPVLDSDGSFALVSKLTVDKSRWQQGNVFSCSVMHEALHNHYTQKSLSLSPG

B23B62-Fab-Fc arm light chain (SEQ ID NO: 688):
DIVMTQSPDSLAVSLGERATINCRASQSVDYNGISYMEIWYQQKPGQPPKLLIYAASNPESGVPDR

FSGSGSGTDFTLTISSLQAEDVAVYYCQQIIEDPWTFGQGTKVEIKRTVAAPSVFIFPPSDEQLKSG

TASVVCLLNNFYPREAKVQWKVDNALQSGNSQESVTEQDSKDSTYSLSSTLTLSKADYEKHKV

YACEVTHQGLSSPVTKSFNRGEC

CD3B219-Fab-Fc arm heavy chain (SEQ ID NO: 689):
EVQLVESGGGLVQPGGSLRLSCAASGFTFNTYAMNWVRQAPGKGLEWVARIRSKYNNYATYY

AASVKGRFTISRDDSKNSLYLQMNSLKTEDTAVYYCVRHGNFGNSYVSWFAYWGQGTLVTVSS

ASTKGPSVFPLAPSSKSTSGGTAALGCLVKDYFPEPVTVSWNSGALTSGVHTFPAVLQSSGLYSL

SSVVTVPSSSLGTQTYICNVNHKPSNTKVDKKVEPKSCDKTHTCPPCPAPEAAGGPSVFLFPPKPK

DTLMISRTPEVTCVVVSVSHEDPEVKFNWYVDGVEVHNAKTKPREEQYNSTYRVVSVLTVLHQ

DWLNGKEYKCKVSNKALPAPIEKTISKAKGQPREPQVYVYPPSREEMTKNQVSLTCLVKGFYPS

DIAVEWESNGQPENNYKTTPPVLDSDGSFALVSKLTVDKSRWQQGNVFSCSVMHEALHNHYTQ

KSLSLSPG

CD3B219-Fab-Fc arm light chain (SEQ ID NO: 690):
QTVVTQEPSLTVSPGGTVTLTCRSSTGAVTTSNYANWVQQKPGQAPRGLIGGTNKRAPGTPARF

SGSLLGGKAALTLSGVQPEDEAEYYCALWYSNLWVFGGGTKLTVLGQPKAAPSVTLFPPSSEEL

QANKATLVCLISDFYPGAVTVAWKADSSPVKAGVETTTPSKQSNNKYAASSYLSLTPEQWKSHR

SYSCQVTHEGSTVEKTVAPTECS

Engineering of HLA-G Fab-Fc for HLA-G/CD3 Bispecific Generation

The HLA-G specific VH and VL regions were engineered in VH-CH1-hinge-CH2-CH3 and VL-CL formats respectively. The polypeptide of SEQ ID NO: 326 comprising the Fc silencing mutations L234A/L235A/D265S and the CH3 mutations T350V/T366L/K392L/T394W designed to promote selective heterodimerization was used to generate the HLA-G specific VH-CH1-hinge-CH2-CH3. The polypeptides of SEQ ID NO: 363 or 364 were used to generate the HLA-G specific VL-CL.

The amino acid sequences of HLA-G Fab-Fc HC and LC are shown in Tables 63 and 64, respectively. The cDNA SEQ ID Nos of HLA-G Fab-Fc HC and LC are listed in Table 65.

Table 63 shows the amino acid sequences of anti-HLA-G Fab-Fc heavy chains (HCs).

| Fab-Fc Heavy chain | SEQ ID NO: | Amino acid sequence |
|---|---|---|
| MHGB732-Fab-Fc HC | 668 | QVQLQQSGPGLVKPSQTLSLTCAISGDSVSSNSAAWNWIRQSPSRGLEWLGRTYYRSKWY NDYAVSVKSRITINPDTSKNQISLQLNSVTPEDTAVYYCAGDRRYGIVGLPFAYWGQGTLVT VSSASTKGPSVFPLAPSSKSTSGGTAALGCLVKDYFPEPVTVSWNSGALTSGVHTFPAVLQS SGLYSLSSVVTVPSSSLGTQTYICNVNHKPSNTKVDKKVEPKSCDKTHTCPPCPAPEAAGGP SVFLFPPKPKDTLMISRTPEVTCVVVSVSHEDPEVKFNWYVDGVEVHNAKTKPREEQYNST YRVVSVLTVLHQDWLNGKEYKCKVSNKALPAPIEKTISKAKGQPREPQVYVLPPSREEMTK NQVSLLCLVKGFYPSDIAVEWESNGQPENNYLTWPPVLDSDGSFFLYSKLTVDKSRWQQG NVFSCSVMHEALHNHYTQKSLSLSPG |
| MHGB738-Fab-Fc HC | 669 | QVQLQQSGPGLVKPSQTLSLTCAISGDSVSSNRAAWNWIRQSPSRGLEWLGRTYYRSKWY NDYAVSVKSRITINPDTSKNQISLQLNSVTPEDTAVYYCARVRPGIPFDYWGQGTPVTVSSA STKGPSVFPLAPSSKSTSGGTAALGCLVKDYFPEPVTVSWNSGALTSGVHTFPAVLQSSGLY SLSSVVTVPSSSLGTQTYICNVNHKPSNTKVDKKVEPKSCDKTHTCPPCPAPEAAGGPSVFL FPPKPKDTLMISRTPEVTCVVVSVSHEDPEVKFNWYVDGVEVHNAKTKPREEQYNSTYRV VSVLTVLHQDWLNGKEYKCKVSNKALPAPIEKTISKAKGQPREPQVYVLPPSREEMTKNQV SLLCLVKGFYPSDIAVEWESNGQPENNYLTWPPVLDSDGSFFLYSKLTVDKSRWQQGNVF SCSVMHEALHNHYTQKSLSLSPG |
| MHGB712-Fab-Fc HC | 670 | QVQLQQSGPGLVKPSQTLSLTCAISGDSVSSNRAAWNWIRQSPSRGLEWLGRTYYRSKWY NDYAVSVKSRITINPDTSKNQISLQLNSVTPEDTAVYYCARVRPGIPFDYWGQGTPVTVSSA STKGPSVFPLAPSSKSTSGGTAALGCLVKDYFPEPVTVSWNSGALTSGVHTFPAVLQSSGLY SLSSVVTVPSSSLGTQTYICNVNHKPSNTKVDKKVEPKSCDKTHTCPPCPAPEAAGGPSVFL |

-continued

| Fab-Fc Heavy chain | SEQ ID NO: | Amino acid sequence |
|---|---|---|
| | | FPPKPKDTLMISRTPEVTCVVVSVSHEDPEVKFNWYVDGVEVHNAKTKPREEQYNSTYRV VSVLTVLHQDWLNGKEYKCKVSNKALPAPIEKTISKAKGQPREPQVYVLPPSREEMTKNQV SLLCLVKGFYPSDIAVEWESNGQPENNYLTWPPVLDSDGSFFLYSKLTVDKSRWQQGNVF SCSVMHEALHNHYTQKSLSLSPG |

Table 64 shows the amino acid sequences of anti-HLA-G Fab-Fc light chains (LCs).

| Fab-Fc Light chain | SEQ ID NO: | Amino acid sequence |
|---|---|---|
| MHGB732-Fab-Fc LC | 671 | DIVMTQSPDSLAVSLGERATINCKSSQSVLHSSNNKNYLTWFQQKPGQPPKLLIYWASTRE SGVPDRFSGSGSGTDFTLTISSLQAEDVAVYYCHQYYSTPPTFGQGTKVEIKRTVAAPSVFIF PPSDEQLKSGTASVVCLLNNFYPREAKVQWKVDNALQSGNSQESVTEQDSKDSTYSLSSTL TLSKADYEKHKVYACEVTHQGLSSPVTKSFNRGEC |
| MHGB738-Fab-Fc LC | 672 | DIVMTQSPDSLAVSLGERATINCKSSQSVLFSSNNKNYLAWYQQKPGQPPKLLIYWASTRE SGVPDRFSGSVSGTDFTLTISSLQAEDVAVYYCQQYHSTPWTFGQGTKVEIKRTVAAPSVFI FPPSDEQLKSGTASVVCLLNNFYPREAKVQWKVDNALQSGNSQESVTEQDSKDSTYSLSST LTLSKADYEKHKVYACEVTHQGLSSPVTKSFNRGEC |
| MHGB712-Fab-Fc LC | 673 | DIVMTQSPDSLAVSLGERATINCKSSQSVLFSSNNKNYLAWYQQKPGQPPKLLIYWASTRE SGVPDRFSGSVSGTDFTLTISSLQAEDVAVYYCQQYHSTPWTFGQGTKVEIKRTVAAPSVFI FPPSDEQLKSGTASVVCLLNNFYPREAKVQWKVDNALQSGNSQESVTEQDSKDSTYSLSST LTLSKADYEKHKVYACEVTHQGLSSPVTKSFNRGEC |

Table 65 shows the cDNA sequences of anti-HLA-G Fab-Fc light chains (LCs) and heavy chains (HCs).

| Fab-Fc | SEQ ID NO: | cDNA sequence |
|---|---|---|
| MHGB732-Fab-Fc HC | 674 | CAAGTACAACTGCAACAAAGTGGTCCTGGGCTCGTGAAGCCTTCCCAGACTCTCAGCCT CACATGCGCTATAAGTGGGGATTCTGTTTCCTCAAATTCAGCAGCCTGGAATTGGATAC GACAGTCTCCATCCCGTGGCCTTGAGTGGCTTGGTAGAACTTATTACCGATCCAAGTGG TACAATGATTACGCCGTTTCAGTGAAGTCCCGCATTACTATTAATCCCGACACATCTAAG AATCAAATTTCATTGCAACTGAATAGCGTAACACCCGAAGATACAGCAGTTTATTATTG TGCAGGTGATCGACGCTACGGCATAGTGGGACTTCCTTTCGCCTATTGGGGCCAAGGG ACACTGGTCACTGTGTCATCCGCCTCCACCAAGGGCCCATCGGTCTTCCCCCTGGCACC CTCCTCCAAGAGCACCTCTGGGGGCACAGCGGCCCTGGGCTGCCTGGTCAAGGACTAC TTCCCCGAACCGGTGACGGTGTCGTGGAACTCAGGCGCCCTGACCAGCGGCGTGCACA CCTTCCCGGCTGTCCTACAGTCCTCAGGACTCTACTCCCTCAGCAGCGTGGTGACCGTG CCCTCCAGCAGCTTGGGCACCCAGACCTACATCTGCAACGTGAATCACAAGCCCAGCAA CACCAAGGTGGACAAGAAAGTTGAGCCCAAATCTTGTGACAAAACTCACACATGTCCA CCGTGCCCAGCACCTGAAGCAGCAGGGGGACCGTCAGTCTTCCTCTTCCCCCCAAAACC CAAGGACACCCTCATGATCTCCCGGACCCCTGAGGTCACATGCGTGGTGGTGAGCGTG AGCCACGAAGACCCTGAGGTCAAGTTCAACTGGTACGTGGACGGCGTGGAGGTGCAT AATGCCAAGACAAAGCCGCGGGAGGAGCAGTACAACAGCACGTACCGTGTGGTCAGC GTCCTCACCGTCCTGCACCAGGACTGGCTGAATGGCAAGGAGTACAAGTGCAAGGTCT CCAACAAAGCCCTCCCAGCCCCCATCGAGAAAACCATCTCCAAAGCCAAAGGGCAGCC CCGAGAACCACAGGTGTACGTGCTGCCCCCATCCCGGGAGGAGATGACCAAGAACCA GGTCAGCCTGCTGTGCCTGGTCAAAGGCTTCTATCCCAGCGACATCGCCGTGGAGTGG GAGAGCAATGGGCAGCCGGAGAACAACTACCTCACCTGGCCTCCCGTGCTGGACTCCG ACGGCTCCTTCTTCCTCTACAGCAAGCTCACCGTGGACAAGTCTAGATGGCAGCAGGG GAACGTCTTCTCATGCTCCGTGATGCATGAGGCTCTGCACAACCACTACACGCAGAAGA GCCTCTCCCTGTCTCCGGGT |
| MHGB732-Fab-Fc LC | 675 | GACATCGTAATGACACAGTCACCAGATTCATTGGCAGTTAGTCTGGGTGAAAGGGCAA CAATCAACTGCAAGTCTTCTCAGAGTGTACTGCATAGTTCTAACAATAAGAACTACCTTA CCTGGTTTCAACAGAAACCAGGTCAGCCCCCCAAGTTGCTGATTTACTGGGCAAGCACC CGCGAATCCGGCGTTCCCGATCGATTTTCAGGTTCCGGGAGTGGGACCGACTTTACCTT GACCATCTCTTCCTTGCAGGCCGAAGATGTAGCCGTCTATTACTGCCATCAGTATTACTC TACTCCCCCCACATTCGGTCAAGGTACAAAAGTTGAGATAAAACGGACAGTGGCCGCT CCTTCCGTGTTCATCTTCCCACCTTCCGACGAGCAGCTGAAGTCCGGCACAGCTTCTGTC GTGTGCCTGCTGAACAACTTCTACCCTCGGGAAGCCAAGGTGCAGTGGAAGGTGGACA ATGCCCTGCAGTCCGGCAACTCCCAAGAGTCTGTGACCGAGCAGGACTCCAAGGACAG CACCTACAGCCTGTCCTCCACACTGACCCTGTCCAAGGCCGACTACGAGAAGCACAAG GTGTACGCCTGCGAAGTGACCCATCAGGGCCTGTCTAGCCCTGTGACCAAGTCTTTCAA CCGGGGCGAGTGT |

-continued

| Fab-Fc | SEQ ID NO: | cDNA sequence |
|---|---|---|
| MHGB738-Fab-Fc HC | 676 | CAGGTGCAGCTTCAACAGAGCGGACCTGGTCTGGTTAAGCCTTCCC AAACCCTGAGCCTGACTTGTGCTATTTCCGGGGATAGTGTTAGCTCC AATAGGGCAGCATGGAACTGGATCAGACAGTCCCCAAGCCGTGGAC TTGAGTGGCTTGGACGTACTTATTACAGGAGTAAATGGTACAATGATT ATGCCGTTTCTGTGAAGAGCCGTATTACTATAAACCCAGATACTTCTA AAAATCAAATTTCCCTTCAGCTCAACTCAGTTACACCAGAGGATACTG CAGTCTATTATTGCGCAAGAGTTCGACCTGGCATTCCCTTCGATTATT GGGGGCAGGGGACACCCGTTACTGTGTCCTCAGCCTCCACCAAGGG CCCATCGGTCTTCCCCCTGGCACCCTCCTCCAAGAGCACCTCTGGG GGCACAGCGGCCCTGGGCTGCCTGGTCAAGGACTACTTCCCCGAAC CGGTGACGGTGTCGTGGAACTCAGGCGCCCTGACCAGCGGCGTGC ACACCTTCCCGGCTGTCCTACAGTCCTCAGGACTCTACTCCCTCAGC AGCGTGGTGACCGTGCCCTCCAGCAGCTTGGGCACCCAGACCTACA TCTGCAACGTGAATCACAAGCCCAGCAACACCAAGGTGGACAAGAAA GTTGAGCCCAAATCTTGTGACAAAACTCACACATGTCCACCGTGCCC AGCACCTGAAGCAGCAGGGGGACCGTCAGTCTTCCTCTTCCCCCCA AAACCCAAGGACACCCTCATGATCTCCCGGACCCCTGAGGTCACATG CGTGGTGGTGAGCGTGAGCCACGAAGACCCTGAGGTCAAGTTCAAC TGGTACGTGGACGGCGTGGAGGTGCATAATGCCAAGACAAAGCCGC GGGAGGAGCAGTACAACAGCACGTACCGTGTGGTCAGCGTCCTCAC CGTCCTGCACCAGGACTGGCTGAATGGCAAGGAGTACAAGTGCAAG GTCTCCAACAAAGCCCTCCCAGCCCCCATCGAGAAAACCATCTCCAA AGCCAAAGGGCAGCCCCGAGAACCACAGGTGTACGTGCTGCCCCCA TCCCGGGAGGAGATGACCAAGAACCAGGTCAGCCTGCTGTGCCTGG TCAAAGGCTTCTATCCCAGCGACATCGCCGTGGAGTGGGAGAGCAA TGGGCAGCCGGAGAACAACTACCTCACCTGGCCTCCCGTGCTGGAC TCCGACGGCTCCTTCTTCCTCTACAGCAAGCTCACCGTGGACAAGTC TAGATGGCAGCAGGGGAACGTCTTCTCATGCTCCGTGATGCATGAG GCTCTGCACAACCACTACACGCAGAAGAGCCTCTCCCTGTCTCCGG GT |
| MHGB738-Fab-Fc LC | 677 | GATATTGTTATGACACAGTCCCCAGATTCATTGGCAGTAAGCCTCGGTGAACGGGCTAC TATTAACTGTAAGTCTTCCCAGAGTGTATTGTTCTCTTCAAATAACAAAAACTACCTGGC ATGGTATCAGCAAAAGCCTGGTCAACCCCCTAAACTTCTCATATACTGGGCATCCACTC GGGAGAGCGGTGTGCCAGACCGTTTCTCAGGGAGTGTGTCAGGTACAGATTTTACACT CACAATTTCCAGCCTCCAAGCCGAAGACGTTGCAGTATATTATTGCCAACAATATCACTC TACACCTTGGACATTTGGTCAAGGTACTAAAGTCGAAATCAAACGGACAGTGGCCGCT CCTTCCGTGTTCATCTTCCCACCTTCCGACGAGCAGCTGAAGTCCGGCACAGCTTCTGTC GTGTGCCTGCTGAACAACTTCTACCCTCGGGAAGCCAAGGTGCAGTGGAAGGTGGACA ATGCCCTGCAGTCCGGCAACTCCCAAGAGTCTGTGACCGAGCAGGACTCCAAGGACAG CACCTACAGCCTGTCCTCCACACTGACCCTGTCCAAGGCCGACTACGAGAAGCACAAG GTGTACGCCTGCGAAGTGACCCATCAGGGCCTGTCTAGCCCTGTGACCAAGTCTTTCAA CCGGGGCGAGTGT |
| MHGB712-Fab-Fc HC | 678 | CAGGTGCAGCTTCAACAGAGCGGACCTGGTCTGGTTAAGCCTTCCCAAACCCTGAGCCT GACTTGTGCTATTTCCGGGGATAGTGTTAGCTCCAATAGGGCAGCATGGAACTGGATC AGACAGTCCCCAAGCCGTGGACTTGAGTGGCTTGGACGTACTTATTACAGGAGTAAAT GGTACAATGATTATGCCGTTTCTGTGAAGAGCCGTATTACTATAAACCCAGATACTTCT AAAAATCAAATTTCCCTTCAGCTCAACTCAGTTACACCAGAGGATACTGCAGTCTATTAT TGCGCAAGAGTTCGACCTGGCATTCCCTTCGATTATTGGGGGCAGGGGACACCCGTTA CTGTGTCCTCAGCCTCCACCAAGGGCCCATCGGTCTTCCCCCTGGCACCCTCCTCCAAGA GCACCTCTGGGGGCACAGCGGCCCTGGGCTGCCTGGTCAAGGACTACTTCCCCGAACC GGTGACGGTGTCGTGGAACTCAGGCGCCCTGACCAGCGGCGTGCACACCTTCCCGGCT GTCCTACAGTCCTCAGGACTCTACTCCCTCAGCAGCGTGGTGACCGTGCCCTCCAGCAG CTTGGGCACCCAGACCTACATCTGCAACGTGAATCACAAGCCCAGCAACACCAAGGTG GACAAGAAAGTTGAGCCCAAATCTTGTGACAAAACTCACACATGTCCACCGTGCCCAG CACCTGAAGCAGCAGGGGGACCGTCAGTCTTCCTCTTCCCCCCAAAACCCAAGGACACC CTCATGATCTCCCGGACCCCTGAGGTCACATGCGTGGTGGTGAGCGTGAGCCACGAAG ACCCTGAGGTCAAGTTCAACTGGTACGTGGACGGCGTGGAGGTGCATAATGCCAAGAC AAAGCCGCGGGAGGAGCAGTACAACAGCACGTACCGTGTGGTCAGCGTCCTCACCGTC CTGCACCAGGACTGGCTGAATGGCAAGGAGTACAAGTGCAAGGTCTCCAACAAAGCCC TCCCAGCCCCCATCGAGAAAACCATCTCCAAAGCCAAAGGGCAGCCCCGAGAACCACA GGTGTACGTGCTGCCCCCATCCCGGGAGGAGATGACCAAGAACCAGGTCAGCCTGCTG TGCCTGGTCAAAGGCTTCTATCCCAGCGACATCGCCGTGGAGTGGGAGAGCAATGGGC AGCCGGAGAACAACTACCTCACCTGGCCTCCCGTGCTGGACTCCGACGGCTCCTTCTTC CTCTACAGCAAGCTCACCGTGGACAAGTCTAGATGGCAGCAGGGGAACGTCTTCTCAT GCTCCGTGATGCATGAGGCTCTGCACAACCACTACACGCAGAAGAGCCTCTCCCTGTCT CCGGGT |
| MHGB712-Fab-Fc LC | 679 | GATATTGTTATGACACAGTCCCCAGATTCATTGGCAGTAAGCCTCGGTGAACGGGCTAC TATTAACTGTAAGTCTTCCCAGAGTGTATTGTTCTCTTCAAATAACAAAAACTACCTGGC ATGGTATCAGCAAAAGCCTGGTCAACCCCCTAAACTTCTCATATACTGGGCATCCACTC GGGAGAGCGGTGTGCCAGACCGTTTCTCAGGGAGTGTGTCAGGTACAGATTTTACACT CACAATTTCCAGCCTCCAAGCCGAAGACGTTGCAGTATATTATTGCCAACAATATCACTC TACACCTTGGACATTTGGTCAAGGTACTAAAGTCGAAATCAAACGGACAGTGGCCGCT CCTTCCGTGTTCATCTTCCCACCTTCCGACGAGCAGCTGAAGTCCGGCACAGCTTCTGTC |

-continued

| Fab-Fc | SEQ ID NO: | cDNA sequence |
|---|---|---|
| | | GTGTGCCTGCTGAACAACTTCTACCCTCGGGAAGCCAAGGTGCAGTGGAAGGTGGACA ATGCCCTGCAGTCCGGCAACTCCCAAGAGTCTGTGACCGAGCAGGACTCCAAGGACAG CACCTACAGCCTGTCCTCCACACTGACCCTGTCCAAGGCCGACTACGAGAAGCACAAG GTGTACGCCTGCGAAGTGACCCATCAGGGCCTGTCTAGCCCTGTGACCAAGTCTTTCAA CCGGGGCGAGTGT |

Engineering of HLA-G scFv-Fc for HLA-G/CD3 Bispecific Generation

HLA-G VH/VL regions engineered as scFvs in either VH-Linker-VL or VL-linker-VH orientations using the linker of SEQ ID NO: 31 (Table 2) as described in Example 2 were further engineered into a scFv-hinge-CH2-CH3 format comprising the Fc silencing mutation (L234A/L235A/D265S) and the T350V/T366L/K392L/T394W mutations designed to promote selective heterodimerization and expressed as IgG1. The polypeptide of SEQ ID NO: 321 was used as the constant domain hinge-CH2-CH3.

Amino acid sequences of anti-HLA-G molecules in scFv-hinge-CH2-CH3 format (scFv-Fc) are shown in Table 66. cDNA sequences of anti-HLA-G molecules in scFv-hinge-CH2-CH3 format (scFv-Fc) are listed in Table 67.

TABLE 66 amino acid sequences of anti-HLA-G scFv-Fc bi-specific arms.

| scFv-Fc | SEQ ID NO: | Amino acid sequence |
|---|---|---|
| MHGB732-LH-scFv-Fc | 680 | DIVMTQSPDSLAVSLGERATINCKSSQSVLHSSNNKNYLTWFQQKPGQPPKLLIYWASTRE SGVPDRFSGSGSGTDFTLTISSLQAEDVAVYYCHQYYSTPPTFGQGTKVEIKGGSEGKSSGS GSESKSTGGSQVQLQQSGPGLVKPSQTLSLTCAISGDSVSSNSAAWNWIRQSPSRGLEWL GRTYYRSKWYNDYAVSVKSRITINPDTSKNQISLQLNSVTPEDTAVYYCAGDRRYGIVGLPF AYWGQGTLVTVSSEPKSSDKTHTCPPCPAPEAAGGPSVFLFPPKPKDTLMISRTPEVTCVV VSVSHEDPEVKFNWYVDGVEVHNAKTKPREEQYNSTYRVVSVLTVLHQDWLNGKEYKCK VSNKALPAPIEKTISKAKGQPREPQVYVLPPSREEMTKNQVSLLCLVKGFYPSDIAVEWESN GQPENNYLTWPPVLDSDGSFFLYSKLTVDKSRWQQGNVFSCSVMHEALHNHYTQKSLSLS PG |
| MHGB737-LH-scFv-Fc | 681 | DIQMTQSPSTLSASVGDRVTITCRASQSISSWLAWYQQKPGKAPKLLIYKASSLESGVPSRF SGSGSGTEFTLTISSLQPDDFATYYCQQYNSYSLTFGGGTKVDIKGGSEGKSSGSGSESKSTG GSEVQLLESGGGLVQPGGSLRLSCAASGFTFSSYAMHWVRQAPGKGLEWVSGISGSGFST YYVDSVKGRFTISRDNSKNTLYLQMNSLRAEDTAVYYCAKDNLVAGTVFDYWGQGTLVTV SSEPKSSDKTHTCPPCPAPEAAGGPSVFLFPPKPKDTLMISRTPEVTCVVVSVSHEDPEVKF NWYVDGVEVHNAKTKPREEQYNSTYRVVSVLTVLHQDWLNGKEYKCKVSNKALPAPIEKT ISKAKGQPREPQVYVLPPSREEMTKNQVSLLCLVKGFYPSDIAVEWESNGQPENNYLTWPP VLDSDGSFFLYSKLTVDKSRWQQGNVFSCSVMHEALHNHYTQKSLSLSPG |

TABLE 67 cDNA sequences of anti-HLA-G scFv-Fc bi-specific arms.

| scFv-Fc | SEQ ID NO: | cDNA sequence |
|---|---|---|
| MHGB732-scFv-LH-Fc | 682 | GACATCGTGATGACCCAGTCTCCAGACAGCCTGGCTGTGTCTCTGGGCGAGAGAGCTA CCATCAACTGCAAGTCCAGCCAGTCCGTGCTGCACTCCTCCAACAACAAGAACTACCTG ACCTGGTTCCAGCAGAAGCCCGGCCAGCCTCCTAAGCTGCTGATCTACTGGGCCTCCAC CCGCGAGTCTGGTGTGCCCGATAGATTCTCCGGCTCTGGCTCTGGCACCGACTTTACCC TGACAATCAGCTCCCTGCAGGCCGAGGATGTGGCCGTGTACTACTGCCACCAGTACTAC AGCACCCCTCCTACCTTTGGCCAGGGCACCAAGGTGGAAATCAAGGGCGGATCTGAGG GAAAGTCCAGCGGCTCCGGCAGCGAAAGCAAGTCCACCGGCGGAAGCCAGGTTCAGC TGCAGCAGTCTGGCCCTGGACTGGTCAAGCCCTCTCAGACCCTGTCTCTGACCTGTGCC ATCTCCGGCGACTCCGTGTCCTCTAATTCTGCCGCCTGGAACTGGATCCGGCAGTCTCC TAGTAGAGGCCTGGAATGGCTGGGCAGAACCTACTACCGGTCCAAGTGGTACAACGAC TACGCCGTGTCCGTGAAGTCCCGGATCACCATCAATCCCGACACCTCCAAGAACCAGAT CTCCCTGCAGCTCAACAGCGTGACCCCTGAGGATACCGCCGTGTACTACTGTGCCGGCG ATCGGAGATATGGCATCGTGGGCCTGCCTTTTGCTTACTGGGGACAGGGCACACTGGT CACCGTTTCTTCTGAGCCCAAATCTAGCGACAAAACTCACACTTGTCCACCGTGCCCAGC ACCTGAAGCAGCAGGGGGACCGTCAGTCTTCCTCTTCCCCCCAAAACCCAAGGACACCC TCATGATCTCCCGGACCCCTGAGGTCACATGCGTGGTGGTGAGCGTGAGCCACGAAGA CCCTGAGGTCAAGTTCAACTGGTACGTGGACGGCGTGGAGGTGCATAATGCCAAGACA AAGCCGCGGGAGGAGCAGTACAACAGCACGTACCGTGTGGTCAGCGTCCTCACCGTCC TGCACCAGGACTGGCTGAATGGCAAGGAGTACAAGTGCAAGGTGTCCAACAAAGCCC TCCCAGCCCCCATCGAGAAAACCATCTCCAAAGCCAAAGGGCAGCCCCGAGAACCACA GGTGTACGTGCTGCCCCCATCCCGGGAGGAGATGACCAAGAACCAGGTCAGCCTGCTG |

TABLE 67-continued cDNA sequences of anti-HLA-G scFv-Fc bi-specific arms.

| scFv-Fc | SEQ ID NO: | cDNA sequence |
|---|---|---|
| | | TGCCTGGTCAAAGGCTTCTATCCCAGCGACATCGCCGTGGAGTGGGAGAGCAATGGGC<br>AGCCGGAGAACAACTACCTCACCTGGCCTCCCGTGCTGGACTCCGACGGCTCCTTCTTC<br>CTCTACAGCAAGCTCACCGTGGACAAGTCCAGATGGCAGCAGGGGAACGTCTTCTCAT<br>GCTCCGTGATGCATGAGGCTCTGCACAACCACTACACGCAGAAGTCTCTCTCCCTGTCT<br>CCGGGA |
| MHG6737-LH-scFv-Fc | 683 | gatattcagatgacccaatcccccagtacccttagtgctagtgtgggagaccgagtgaccattacctgcagagcat<br>cccaatccataagctcctggctcgcctggtatcagcaaaagccaggcaaggcacctaagctgcttatttacaaagc<br>atcctcattggagtccggcgtaccctcacgtttctctggctcaggctccgggacagagtttacattgaccatctctag<br>ccttcagccagatgactttgctacatactattgtcaacaatataacagctactctctgaccttcgggggtgggacca<br>aagtggatattaaaggcggctccgagggcaagagcagcggcagcggcagcgagagcaagagcaccggcggca<br>gcgaagtccaacttcttgagagtggtggtggcctcgtccagccaggaggttctctccggctctcatgtgctgcaagt<br>ggctttactttcagctcttacgccatgcactgggtgcgacaggctcccgggaagggtcttgagtgggtgtctggtata<br>agtggttcaggcttttcaacctactatgtcgattccgtcaagggccggtttacaatttcaagggacaattctaagaat<br>acactgtatctccaaatgaatagtctcagagccgaagataccgccgtttactactgcgccaaagataatcttgtggc<br>tgggactgtcttcgactattggggtcagggtacattggtaaccgtaagtagtgagcccaaatctagcgacaaaact<br>cacacatgtccaccgtgcccagcacctgaagcagcaggggggaccgtcagtcttcctcttccccccaaaacccaagg<br>acaccctcatgatctcccggacccctgaggtcacatgcgtggtggtgagcgtgagccacgaagaccctgaggtca<br>agttcaactggtacgtggacggcgtggaggtgcataatgccaagacaaagccgcgggaggagcagtacaacagc<br>acgtaccgtgtggtcagcgtcctcaccgtcctgcaccaggactggctgaatggcaaggagtacaagtgcaaggtct<br>ccaacaaagccctcccagcccccatcgagaaaaccatctccaaagccaaagggcagccccgagaaccacaggtg<br>tacgtgctgcccccatcccgggaggagatgaccaagaaccaggtcagcctgctgtgcctggtcaaaggcttctatc<br>ccagcgacatcgccgtggagtgggagagcaatgggcagccggagaacaactacctcacctggcctcccgtgctgg<br>actccgacggctccttcttcctctacagcaagctcaccgtggacaagtctagatggcagcaggggaacgtcttctca<br>tgctccgtgatgcatgaggctctgcacaaccactacacgcagaagagcctctccctgtctccgggt |

HLA-G×CD3 Bispecifics

The VH/VL regions of the anti-CD3 antibodies CD3B376, CD3B450, CD3B219, and CD3W246, engineered as Fab-Fcs and the VH/VL regions of the anti-HLA-G antibodies MHGB738, MHGB732 and MHGB737 engineered as scFv-Fcs in both HL and LH orientations as described above, were expressed to generate bispecific antibodies, yielding HLA-G/CD3 bispecific antibodies with a HLA-G binding arm in a format scFv-hinge-CH2-CH3 and a CD3 binding arm in a format of: heavy chain: VH-CH1-linker-CH2-CH3 and light chain: VL-CL (Table 68). B23B62-Fab-Fc arm was used as an isotype control for the CD3-specific arm.

Alternatively, the VH/VL regions of the anti-CD3 antibodies CD3W246, CD3B450, and CD3B219 engineered as scFv-Fcs in HL and/or LH orientations (see Table 68) and the VH/VL regions of the anti-HLA-G antibodies MHGB738, MHGB732 and MHGB737 engineered as Fabs as described above, were expressed to generate bispecific antibodies, yielding HLA-G/CD3 bispecific antibodies with a HLA-G binding arm in the format of a heavy chain VH-CH1-linker-CH2-CH3 and light chain VL-CL and a CD3 binding arm in a format scFv-hinge-CH2-CH3. The linker used to generate the anti-scFv is the linker of SEQ ID NO: 31 (Table 68).

T350V_L351Y_F405A_Y407V CH3 mutations were engineered into one heavy chain and T350V_T366L_K392L_T394W CH3 mutations were engineered into the other heavy chain as described above. In addition, both HK2 and CD3 binding arms were engineered to contain Fc effector silencing mutations L234A_L235A_D265S as described above.

The engineered chains were expressed, and the resulting bispecific constructs purified using standard methods. The bispecifics were characterized for their binding to HLA-G and CD3, their in vitro cytotoxicity, immune checkpoint response, and in vivo efficacy as described in Examples 15-17.

TABLE 68

HLA-G × CD3 bispecifics.

| Bispecific Name | CD3 arm | CD3 arm SEQ ID NO: | HLA-G arm | HLA-G arm SEQ ID NO: |
|---|---|---|---|---|
| HC3B239 | null-scFv-Fc | 686 | MHGB738-Fab-Fc | HC: 669<br>LC: 672 |
| HC3B238 | CD3W246-HL-scFv-Fc | 79 | MHGB738-Fab-Fc | HC: 669<br>LC: 672 |
| HC3B237 | CD3W246-LH-scFv-Fc | 80 | MHGB738-Fab-Fc | HC: 669<br>LC: 672 |
| HC3B236 | CD3B450-LH-scFv-Fc | 684 | MHGB738-Fab-Fc | HC: 669<br>LC: 672 |
| HC3B235 | CD3B219-LH-scFv-Fc | 685 | MHGB738-Fab-Fc | HC: 669<br>LC: 672 |
| HC3B234 | null-scFv-Fc | 686 | MHGB732-Fab-Fc | HC: 668<br>LC: 671 |
| HC3B233 | CD3W246-HL-scFv-Fc | 79 | MHGB732-Fab-Fc | HC: 668<br>LC: 671 |

TABLE 68-continued

| HLA-G × CD3 bispecifics. | | | | |
|---|---|---|---|---|
| Bispecific Name | CD3 arm | CD3 arm SEQ ID NO: | HLA-G arm | HLA-G arm SEQ ID NO: |
| HC3B232 | CD3W246-LH-scFv-Fc | 80 | MHGB732-Fab-Fc | HC: 668<br>LC: 671 |
| HC3B231 | CD3B450-LH-scFv-Fc | 684 | MHGB732-Fab-Fc | HC: 668<br>LC: 671 |
| HC3B230 | CD3B219-LH-scFv-Fc | 685 | MHGB732-Fab-Fc | HC: 668<br>LC: 671 |
| HC3B128 | B23B62-Fab-Fc | HC: 687<br>LC: 688 | MHGB732-LH-scFv | 680 |
| HC3B125 | CD3B376-Fab-Fc | HC: 349<br>LC: 350 | MHGB732-LH-scFv-Fc | 680 |
| HC3B258 | CD3B376-Fab-Fc | HC: 349<br>LC: 350 | MHGB732-LH-scFv-Fc | 680 |
| HC3B124 | CD3B219-Fab-Fc | HC: 689<br>LC: 690 | MHGB732-scFv-Fc | 680 |
| HC3B123 | CD3W246-Fab-Fc | HC: 85<br>LC: 90 | MHGB732-LH-scFv-Fc | 680 |
| HC3B225 | B23B62-Fab | HC: 687<br>LC: 688 | MHGB737-scFv-Fc | 681 |
| HC3B216 | CD3B376-Fab-Fc | HC: 349<br>LC: 350 | MHGB737-scFv-Fc | 681 |
| HC3B214 | CD3W246-Fab-Fc | HC: 85<br>LC: 90 | MHGB737-scFv-Fc | 681 |

Example 15. BsAb Formatting and In Vitro Testing

T cell redirection against tumor cells has shown significant promise in the clinic, and we asked whether a bispecific antibody (BsAb) which targets HLA-G and the CD3 subunit of the T cell receptor complex would show cytotoxicity against HLA-G expressing tumor cells. Lead v-regions were formatted as BsAbs with a series of CD3-binding redirection arms (Table 69). Briefly, target cells (NCI-H2009-b2m) at 50,000 cells per well were incubated with antibody at concentrations starting from 10 nM and serially by half-log per well. Purified primary T cells were added at a ratio of 3:1 and the mixture was incubated for 72 hr at 37° C. Staining solution was prepared adding LIVE/DEAD Near-IR stain (Dead Cell Stain, L34976, Invitrogen) at 1 uL per 10^6 cells and Brilliant violet anti CD25 (Biolegend cat. #302630) at 5 uL per 10^6 cells in BD FACS staining buffer. Cell mixtures were dissociated with Accutase prior to addition analysis by flow cytometry. Cells were gated on FSC-A vs SSC-A and CFSE (BL-1) vs SSC-A and non-viable tumor cells were identified by total tumor target cell population for CFSE (BL-1) vs Near IR Live/Dead (RL2-H) gating. Data was analyzed using ForeCyt (Sartorius) advanced metrics to calculate tumor cytoxity. All BsAbs displayed the ability to enhance T cell-mediated cytotoxicity when the HLA-G binding v-region was paired with a CD3 binding arm with EC50 values that were correlated to the binding affinities of both the HLA-G targeting arm and the CD3 targeting arm (Table 69).

TABLE 69

| BsAb designs and cytotoxicity | | | |
|---|---|---|---|
| BsAb Name | CD3 arm | HLA-G arm | Cytotoxicity, EC50 (M) |
| HC3B239 | null-scFv-Fc | MHGB738-Fab-Fc | NA |
| HC3B238 | CD3W246-HL-scFv-Fc | MHGB738-Fab-Fc | 1.72542E−11 |
| HC3B237 | CD3W246-LH-scFv-Fc | MHGB738-Fab-Fc | 1.32773E−10 |
| HC3B236 | CD3B450-LH-scFv-Fc | MHGB738-Fab-Fc | 4.53748E−09 |
| HC3B235 | CD3B219-LH-scFv-Fc | MHGB738-Fab-Fc | 8.37E−11 |
| HC3B234 | null-scFv-Fc | MHGB732-Fab-Fc | N/A |
| HC3B233 | CD3W246-HL-scFv-Fc | MHGB732-Fab-Fc | N/A |
| HC3B232 | CD3W246-LH-scFv-Fc | MHGB732-Fab-Fc | 6.77438E−12 |
| HC3B231 | CD3B450-LH-scFv-Fc | MHGB732-Fab-Fc | 1.26465E−10 |
| HC3B230 | CD3B219-LH-scFv-Fc | MHGB732-Fab-Fc | 9.91577E−12 |
| HC3B128 | B23B62-Fab | MHGB732-LH-scFv | No data |
| HC3B125 | CD3B376-Fab-Fc | MHGB732-LH-scFv-Fc | 5.65197E−11 |
| HC3B258 | CD3B376-Fab-Fc | MHGB732-LH-scFv-Fc | Binding same as HC3B125 |
| HC3B124 | CD3B219-Fab-Fc | MHGB732-scFv-Fc | 3.849E−12 |
| HC3B123 | CD3W246-Fab-Fc | MHGB732-LH-scFv-Fc | 3.24183E−12 |
| HC3B225 | B23B62-Fab | MHGB737-scFv-Fc | No data |
| HC3B216 | CD3B376-Fab-Fc | MHGB737-scFv-Fc | 1.8984E−09 |
| HC3B214 | CD3W246-Fab-Fc | MHGB737-scFv-Fc | 1.37611E−10 |

The BsAbs were further tested for their abilities to mediate T-cell activation and T cell-based cytotoxicity against additional cell lines: Hup-T3 and RERF-LC-Ad-1 (FIGS. 22A-22D). FIGS. 22A-22D show cytotoxicity mediated by HC3B125 against HLA-G expressing tumor cells.

Two BsAbs, HC3B125 and HC3B258, differed only in the presence (HC3B258) or absence (HC3B125) of a codon to express the C-terminal lysine, K447 in the heavy chain. Since the C-terminal lysine of the heavy chain of antibodies is normally proteolytically processed, the two Abs displayed identical mass spectra (Table 70). Additionally, they displayed identical biophysical properties, such as thermal stability and binding affinity for both T cells and for K562-HLA-G cells. Additionally, HC3B258 displayed similar cytotoxicity properties as HC3B125 (FIG. 23).

TABLE 70

Comparison of the biophysical properties of HC3B125 and HC3B258.

| Molecule | Exp. Mass (Da) | Kd (pM) | Tonset | Tm1 | Tm2 | Tagg | T cell binding (EC50, M) | K562-HLA-G cell binding (EC50, M) |
|---|---|---|---|---|---|---|---|---|
| HC3B258 | 128,772.4 | 13 ± 1.2 | 55.0° C. | 63.0° C. | 81.1° C. | 63.9° C. | 6.0E−08 | 1.1E−08 |
| HC3B125 | 128,772.5 | 11 ± 0.5 | 55.3° C. | 63.6° C. | 81.3° C. | 65.3° C. | 6.0E−08 | 1.2E−08 |

Example 16. Observation of Immune Checkpoint Response

We observed that anti-HLA-G mAbs whose mechanism of cytotoxicity features effector function (e.g. ADCC) and CD3×HLA-G BsAbs could induce killing of all cell types which expressing HLA-G. Tumors often escape immune surveillance via up-regulation of certain immune checkpoint modulators which can inhibit immune cells, such as PD-L1 or CTLA-4[9]. We thus asked whether targeting cancer cells for T cell mediated cytotoxicity via CD3×HLA-G BsAbs could overcome expression of immune checkpoint modulators on tumor cells. We measured whether HLA-G-expressing tumor cells expressed immune checkpoint ligands (Table 71). Briefly, cells were cultured as in Example 11, and were then stained with commercial antibodies targeting the receptors indicated in Table 71. Fluorescence was measured using flow cytometry to determine relative expression levels of each receptor. Interestingly, we observed that RERF-LC-Ad1 cells expressed PD-L1 at levels significantly higher than other target cells and that CD3×HLA-G BsAbs could still mediate T cell based cytotoxicity against RERF-LC-Ad1 cells (FIGS. 22A-22D). We observed that our Abs, which target the α3 domain of HLA-G on tumor cells for T cell based cytotoxicity could overcome immune checkpoint ligand expression on tumor cells.

TABLE 71

Comprehensive analysis of immune checkpoint antigen expression on HLA-G expressing tumor cells

| | Signal fold over negative control | | | | |
|---|---|---|---|---|---|
| Ligand name/Cell line name | RERF-LCAd1 | JEG-3 | HUP-T3 | BICR6 | HCC1806 |
| PD-L1(CD274, B7-H1) | 43 | 7 | 9 | | |
| PD-L2(CD273, B7-DC) | 2 | 1 | 2 | | |
| Nectin-1 (CD111, PVRL1) | 2 | 1 | 1 | | |
| Poliovirus receptor (CD155) | 18 | 1 | 23 | | |
| HVEM (CD270, TNFRSF14) | 3 | 1 | 1 | | |
| B7H3(CD276) | 21 | 9 | 1 | | |
| Galectin-9 | 1 | 2 | 3 | | |
| B7-1 (CD80, CD28L) | 1 | 1 | 1 | | |
| MICA/B | 6 | | 2 | | 11 |
| ULBP1 | 1 | | 1 | | 1 |
| ULBP2/5/6 | 2 | | 2 | | 10 |
| ULBP3 | 3 | | 2 | | 6 |
| ULBP4 | 2 | | 1 | | 1 |
| NKG2D-Fc | 1 | | 1 | | 1 |
| NKp46-Fc | 1 | | 1 | | 1 |
| NKp44-Fc | 1 | | 1 | | 1 |
| NKp30-Fc | 1 | | 1 | | 1 |
| CD46 | 1 | 5 | 9 | 12 | |
| CD55 | 141 | 73 | 21 | 15 | |
| CD59 | 78 | 15 | 291 | 120 | |
| In vitro T cell-based cytotoxicity | yes | no | yes | yes | |
| in vitro ADCC background | ok | ok | ok | ok | ok |
| in vitro CDC | no | partial | not tested | not tested | not tested |

Example 17. In Vivo Efficacy

While the correlation between HLA-G expression in patients and a poor prognosis has been established in most types of cancer, the direct role of HLA-G in tumor escape in vivo has thus far not been demonstrated. There are no murine homologues of HLA-G, but also ILT-2, therefore studying of the role of HLA-G requires xenograft models and humanized mice.

Abs and BsAbs were tested for their abilities to mediate anti-tumor efficacy in vivo in a series of mouse studies. The study shown in (FIG. 24A-24B, Table 72) consisted of efficacy experiment with the pancreatic tumor model PAXF 1657 (Charles River Discovery Research Services Germany GmbH) implanted subcutaneously in humanized female hNSG-SGM3 mice (NOD.Cg-Prkdc$^{scid}$ Il2rg$^{tm1Wjl}$ Tg(CMV-IL3, CSF2, KITLG) from the Jackson Laboratory. Mice engrafted with human umbilical cord blood-derived CD34$^{+}$ hematopoietic stem cells (HSCs) from three different donors (#2595, #2597 and #5867) had been checked by the animal distributor for the sufficient degree of engraftment of HSCs (>25% human CD45$^{+}$ cells) 10 to 11 weeks after engraftment. PAXF 1657 tumors were implanted 18 days after arrival and the degree of engraftment was re-checked 2 days prior to randomization. The experiment comprised eight groups of 10 or 11 mice each bearing one PAXF 1657 tumor. The absolute tumor volumes (ATVs) were determined by two-dimensional measurement with a digital caliper (S_Cal EVO Bluetooth, Switzerland) on the day of randomization and then twice weekly. Tumor volumes were calculated according to the formula: Tumor volume=(1× w$^2$)×0.5, where 1=largest diameter and w=width (perpendicular diameter) of the tumor (in mm). At tumor volumes of 46.7 mm$^3$ to 117.7 mm$^3$, mice were distributed among the eight groups, aiming at comparable group mean and median tumor volumes while simultaneously ensuring an even distribution, as much as possible, among the groups of mice humanized with HSCs from the three donors. Each antibody was evaluated at two or three dose levels and was administered on days 0, 3, 7, 10, 14, 17, 21, 24 (intravenously, 2×/week). Antitumor efficacy of all groups was assessed using the vehicle control group as a reference. Tumor growth inhibition (TGI) was determined at the end of the treatment period by the comparison of changes in tumor volumes of the test groups relative to changes in the control group and is expressed as the delta TGI value (denoted TGI in text) in percent. The TGI was calculated using the absolute tumor volumes according to the following formula: Delta TGI, [%]=(1−Mean $(T_x-T_0)$/Mean $(C_x-C_0)$)×100, where $T_0$ and $C_0$ are the absolute tumor volumes in the test and the control group at the start of treatment (i.e. day of randomization) and $T_x$ and $C_x$ are the corresponding absolute tumor volumes at the end of the treatment period. This was day 25 in this study. The experiment was terminated on day 27. HC3B125 significantly inhibited growth of the tumor model PAXF 1657 in hNSG-SGM3 mice. Tumor growth inhibition compared to the vehicle control group was statistically significant for all three dose levels evaluated (Kruskal-Wallis test combined with Dunn's post test, Table 50). Tumors regressed completely in 6/11 animals in the 0.002 mg, 8/11 animals in the 0.006 mg and 9/11 in the 0.02 mg HC3B125 groups. At the end of the experiment, there were 6/7/6 tumor-free survivors in the 0.002 mg/0.006 mg/0.02 mg HC3B125 groups respectively.

Tumor growth was not inhibited by HC3B128 at either dose level tested. While a small reduction in group mean tumor volume was observed at the higher doses of HC3B128 compared to the control group, the differences were not statistically significant (Table 71).

TABLE 72

Pancreatic PDX model efficacy statistics

| Group ID | Treatment [1] | Dose Level [mg/day] | Schedule [Day] | Route | Delta TGI [%] (Day) [2] | Regressions [3] PR | CR | TFS | Td [Days] | Tq [Days] |
|---|---|---|---|---|---|---|---|---|---|---|
| Tumor Model PAXF 1657 - Exp. S317h | | | | | | | | | | |
| 1 | Control Vehicle | 0.1 ml/dose | 0, 3, 7, 10, 14, 17, 21, 24 | i.v. | n/a | 0 | 0 | 0 | 7.2 | 12.6 |
| 2 | HC3B128.004 | 0.02 | 0, 3, 7, 10, 14, 17, 21, 24 | i.v. | 8.4 (25) | 0 | 0 | 0 | 8.9 | 13.5 |
| 3 | HC3B128.004 | 0.2 | 0, 3, 7, 10, 14, 17, 21, 24 | i.v. | 16.2 (25) | 0 | 0 | 0 | 9.7 | 15.3 |
| 4 | HC3B125 | 0.002 | 0, 3, 7, 10, 14, 17, 21, 24 | i.v. | 98.5 (25) | 2 | 6 | 6 | n.r. | n.r. |
| 5 | HC3B125 | 0.006 | 0, 3, 7, 10, 14, 17, 21, 24 | i.v. | 104.4 (25) | 3 | 8 | 7 | n.r. | n.r. |
| 6 | HC3B125 | 0.02 | 0, 3, 7, 10, 14, 17, 21, 24 | i.v. | 97.9 (25) | 1 | 9 | 6 | n.r. | n.r. |

n/a = not applicable;

n.r. = not reached (i.e. group median RTVs always <200%/400%)

Vehicle for antibodies: PBS

[2] Delta TGI values in each group were calculated on the first measurement day after the final 2QW treatment was administered (day 25) according to the formula given in the section Error! Reference source not found.; for additional TGI, T/C and tumor regression values, see Appendix 1.

[3] Partial (PR) and complete regressions (CR) were determined according to the section Error! Reference source not found.

TFS: tumor-free survivor; Td, tumor doubling time; tq, tumor quadrupling time.

Treatment with HC3B125 could also result in tumor growth inhibition in a HuP-T3 cell line derived xenograft (CDX) model (FIG. 25, Table 73). The study consisted of efficacy experiment with the pancreatic tumor model HuP-T3 (Sigma-Aldrich) implanted subcutaneously (10e6 cells/mouse in 50% Cultrex (R&D Systems)) in T cell humanized NSG (Jackson Laboratories) mice. The experiment comprised six groups of 10 mice each bearing one HuP-T3 tumor. On day 7, at tumor volumes of 75 $mm^3$ to 150 $mm^3$, mice were randomized into six groups, aiming to have comparable group mean and median tumor volumes. Mice were engrafted intraperitoneally with T cells (20e6 cells/mouse, 0.2 mL/animal; ALLCELLS 6093 T Cell Donor) after randomization on the same day as randomization. HC3B125 antibody was evaluated at five dose levels. Antitumor efficacy of all groups was assessed using the Null×CD3 treated group as a reference. Treatment started 1 day post T cell engraftment and was performed on days 8, 11, 14, 17, 21, 24, 28, 31, 35, 38, 42, 48 (intraperitoneally, 2×/week). Tumor growth inhibition was determined at the end of the treatment period by the comparison of changes in group mean tumor volumes of the test groups relative to changes in that of the Null×CD3 treated control group and was expressed as the delta TGI value (denoted TGI in text) in percent. Day 42 post tumor implantation was used as the last day for TGI calculations. The experiment was terminated on day 46. HC3B125 significantly inhibited growth of the tumor model HuPT3 in hNSG mice. Tumor growth inhibition compared to the Null×CD3 treated control group was statistically significant for all five dose levels evaluated (Table 73).

TABLE 73

HuP-T3 model efficacy statistics

| Group | Construct | Dose/animal | %ΔTGI (Day 42) | No of CRs (Day 42) |
|---|---|---|---|---|
| 1 | CD3 × Null | — | | |
| 2 | HC3B125 | 0.05 mg/kg | 112% ***p < 0.0001 | |
| 3 | HC3B125 | 0.1 mg/kg | 118% ***p < 0.0001 | 1/9 CRs |
| 4 | HC3B125 | 0.3 mg/kg | 130% ***p < 0.0001 | 1/10 CRs |
| 5 | HC3B125 | 1 mg/kg | 129% ***p < 0.0001 | |
| 6 | HC3B125 | 5 mg/kg | 118% ***p < 0.0001 | 3/10 CRs |

REFERENCES

1 Lee, N. et al. The membrane-bound and soluble forms of HLA-G bind identical sets of endogenous peptides but differ with respect to TAP association. *Immunity* 3, 591-600, doi: 10.1016/1074-7613(95)90130-2 (1995).

2 Juch, H. et al. A novel sandwich ELISA for alpha1 domain based detection of soluble HLA-G heavy chains. *J Immunol Methods* 307, 96-106, doi:10.1016/j.jim.2005.09.016 (2005).

3 Morales, P. J., Pace, J. L., Platt, J. S., Langat, D. K. & Hunt, J. S. Synthesis of beta(2)-microglobulin-free, disulphide-linked HLA-G5 homodimers in human placental villous cytotrophoblast cells. *Immunology* 122, 179-188, doi: 10.1111/j.1365-2567.2007.02623.x (2007).

4 Carosella, E. D., Favier, B., Rouas-Freiss, N., Moreau, P. & Lemaoult, J. Beyond the increasing complexity of the immunomodulatory HLA-G molecule. *Blood* 111, 4862-4870, doi: 10.1182/blood-2007-12-127662 (2008).

5 Carosella, E. D., Rouas-Freiss, N., Tronik-Le Roux, D., Moreau, P. & LeMaoult, J. HLA-G: An Immune Checkpoint Molecule. *Adv Immunol* 127, 33-144, doi: 10.1016/bs.ai.2015.04.001 (2015).

6 Clements, C. S. et al. Crystal structure of HLA-G: a nonclassical MHC class I molecule expressed at the fetal-maternal interface. *Proc Natl Acad Sci U SA* 102, 3360-3365, doi: 10.1073/pnas.0409676102 (2005).

7 Shields, R. L. et al. Lack of fucose on human IgG1 N-linked oligosaccharide improves binding to human Fcgamma RIII and antibody-dependent cellular toxicity. *J Biol Chem* 277, 26733-26740, doi: 10.1074/jbc.M202069200 (2002).

8 Zhang, D. et al. Functional optimization of agonistic antibodies to OX40 receptor with novel Fc mutations to promote antibody multimerization. *MAbs* 9, 1129-1142, doi:10.1080/19420862.2017.1358838 (2017).

9 Wilky, B. A. Immune checkpoint inhibitors: The linchpins of modern immunotherapy. *Immunol Rev* 290, 6-23, doi: 10.1111/imr.12766 (2019).

Example 18. Generation of Bispecific DLL3×CD3

The VH/VL regions of the anti-Delta-like ligand 3 (DLL3) antibodies generated using transgenic mice (Ablexis®) and the VH/VL regions of the anti-CD3 antibodies of Example 1 were engineered into bispecific format and expressed as IgG1. Additionally, the VH/VL regions of CD3-specific antibodies CD3B376 and CD3B450, described in US20200048349, were used.

The designed heavy chain molecules were synthesized into gblocks (IDT; Coralville, IA) containing 15 bp overlaps at the 5' and 3' ends for ligation independent cloning using InFusion method (ClonTech). All light chain constructs were inserted into pLonza vector containing the BswiI and HindIII restriction sites for in-frame ligation to the human kappa constant domain. Murine IgH signal peptides were encoded to allow for efficient secretion of mAbs into culture supernatant. All gblocks were reconstituted in sterile water and incubated at 50° C. for 10 minutes as per manufacturer protocol. pLonza vector (Lonza; Basel, Switzerland) was linearized using EcoRI and HindIII followed by gel extraction and cleanup. A 2:1 mass ratio of linearized vector to insert was used followed by heat pulse at 50° C. for 15 minutes. The infusion reactions were transformed into Stellar competent cells (ClonTech) and resultant colonies were scaled for miniprep. All constructs were sequence verified and scaled up using Endotoxin free maxi preparation kits (Qiagen; Hilden, Germany).

Engineering of CD3 and DLL3 scFvs for Bispecific DLL3×CD3 Generation

CD3 VH/VL regions were engineered as scFvs in either VH-Linker-VL or VL-linker-VH orientations using the linker of SEQ ID NO:31 (Table 2). The VH-Linker-VL or VL-linker-VH scFv molecules binding CD3 were further engineered into a scFv-hinge-CH2-CH3 format comprising Fc silencing mutation (L234A/L235A/D265S) and dimerization mutations to allow for heterodimerization of the DLL3 and CD3 heavy chains.

DLL3 VH/VL regions were engineered as scFvs in a VL-linker-VH orientation using the same linker as for CD3 scFv generation described above of SEQ ID NO:31 (Table 2). The VL-linker-VH scFv molecules binding DLL3 were further engineered into a scFv-hinge-CH2-CH3 format comprising the Fc silencing mutation (L234A/L235A/D265S).

Mutations designed to promote selective heterodimerization of the Fc domain were also engineered in the Fc domain.

Engineering of CD3 and DLL3 Fabs for DLL3/CD3 Bispecific Generation

The CD3 and DLL3 specific VH and VL regions were also engineered in VH-CH1-hinge-CH2-CH3 and VL-CL formats respectively and expressed as IgG1. The Fc silencing mutation L234A/L235A/D265S were introduced in the Fc region. Mutations designed to promote selective heterodimerization of the Fc domain were also engineered in the Fc domain.

Expression of Bispecific DLL3×CD3 Antibodies

The bispecific antibodies were expressed in ExpiCHO-S™ cells by transient transfection with purified plasmid DNA following the manufacturer's recommendations. Briefly, ExpiCHO-S™ cells were maintained in suspension in ExpiCHO™ expression medium (ThermoFisher Scientific, Cat #A29100) in an orbital shaking incubator set at 37° C., 8% $CO_2$ and 125 RPM. The cells were passaged and diluted prior to transfection to $6.0\times10^6$ cells per ml, maintaining cell viability at 99.0% or better. Transient transfections were done using the ExpiFectamine™ CHO transfection kit (ThermoFisher Scientific, Cat #A29131). For each ml of diluted cells to be transfected, 0.5 microgram of each bispecific antibody encoding DNA in ratios of HC1:LC1:HC2=1:2:2 and 0.5 microgram of pAdVAntage DNA (Promega, Cat #E1711) was used and diluted into OptiPRO™ SFM complexation medium. For each liter of cells, 2.56 mL of ExpiFectamine™ CHO reagent was diluted into 8 mL of OptiPRO™. The diluted DNA and transfection reagent were combined for one minute, allowing DNA/lipid complex formation, and then added to the cells. After overnight incubation, ExpiCHO™ feed and ExpiFectamine™ CHO enhancers were added to the cells as per the manufacturer's Standard protocol. Cells were incubated with orbital shaking (125 rpm) at 37° C. for seven days prior to harvesting the culture broth. The culture supernatant from the transiently transfected ExpiCHO-S™ cells was clarified by centrifugation (30 min 3000rcf) followed by filtration (0.2 μm PES membrane, Corning; Corning, NY).

Purification of Bispecific DLL3×CD3

The filtered cell culture supernatant was loaded onto a pre-equilibrated (1×DPBS, pH 7.2) HiTrap MabSelect SuRe Protein A column (GE Healthcare) using an AKTA Avant 150 chromatography system. After loading, the column was washed with 5 column volumes of 1×DPBS, pH7.2. The protein was eluted with 8 column volumes of 0.1 M sodium (Na)-Acetate, pH 3.5. Protein fractions were completely neutralized by the addition of 2.5 M Tris HCl, pH 7.2 to 15% (v/v) of the final volume and syringe filtered (0.2 m). The neutralized protein solution was loaded onto 2×5 mL prepacked CaptureSelect™ IgG-CH1 Affinity Matrix (Thermo Fisher Scientific). The column was washed with 10 column volumes of 1×DPBS, pH7.2. The protein was eluted with 10 column volumes of 0.1 M sodium (Na)-Acetate, pH 3.5. Protein fractions were completely neutralized by the addition of 2.5 M Tris HCl, pH 7.2 to 15% (v/v) of the final volume. The major peak fractions were pooled, dialyzed into 1×DPBS, pH 7.2 with a total of 3 dialysis changes and filtered (0.2 in).

Tables 74-77 show sequence information for the select DLL3/CD3 bispecific antibodies.

TABLE 74

HC and LC amino acid SEQ ID NOs of DLL3/CD3 bispecific antibodies

| | DLL3 arm | | | CD3 arm | | |
|---|---|---|---|---|---|---|
| Bispecific Name | Name | HC1 or scFv - Fc SEQ ID NO: | LC1 SEQ ID NO: | Name | HC2 or scFv - Fc SEQ ID NO: | LC2 SEQ ID NO: |
| DL3B582 | DL3B279-Fab-Fc | 692 | 693 | CD3W245-LH-scFv-Fc | 78 | |
| DL3B583 | DL3B279-Fab-Fc | 692 | 693 | CD3W245-HL-scFv-Fc | 77 | |
| DL3B585 | DL3B279-LH-scFv-Fc | 694 | | CD3B376-Fab-Fc | 349 | 350 |
| DL3B587 | DL3B279-LH-scFv-Fc | 694 | | CD3W245-Fab-Fc | 85 | 88 |
| D3C3B80 | DL3B279-VL-A99G-VH-N27Q_M105T-LH-scFv-Fc (ZW) | 695 | | CD3B376-K477-Fab-Fc | 696 | 350 |
| D3C3BB3 | DL3B279-VL-A99G-VH-N27Q_M105T-LH-scFv-Fc (KIH) | 697 | | CD3B376-Fab-Fc | 349 | 350 |

TABLE 75

Amino acid sequences of selected bispecific antibodies

| Protein | SEQ ID NO: | Amino acid sequence |
|---|---|---|
| DL3B279-Fab HC1 (VH-CH1-hinge-CH2-CH3) | 692 | QVQLVQSGAEVKKPGASVKVSCKASGNTFTNYYI HWVRQAPGQGLEWMGIINPSGGSTSYAQKLQGRMTMTR DTSTSTVYMELSSLRSEDTAVYFCARQGPFIGDAFDIWGQ GTMVTVSSASTKGPSVFPLAPSSKSTSGGTAALGCLVKDY FPEPVTVSWNSGALTSGVHTFPAVLQSSGLYSLSSVVTVP SSSLGTQTYICNVNHKPSNTKVDKKVEPKSCDKTHTCPPC |

TABLE 75-continued

Amino acid sequences of selected bispecific antibodies

| Protein | SEQ ID NO: | Amino acid sequence |
|---|---|---|
| | | PAPEAAGGPSVFLFPPKPKDTLMISRTPEVTCVVVSVSHED PEVKFNWYVDGVEVHNAKTKPREEQYNSTYRVVSVLTV LHQDWLNGKEYKCKVSNKALPAPIEKTISKAKGQPREPQ VYVLPPSREEMTKNQVSLLCLVKGFYPSDIAVEWESNGQ PENNYLTWPPVLDSDGSFFLYSKLTVDKSRWQQGNVFSC SVMHEALHNHYTQKSLSLSPG |
| DL3B279-Fab LC1 (VL-CL) | 693 | DIQMTQSPSSLSASVGDRVTITCRASQGISNYLAW FQQKPGKAPKSLIYAASSLQSGVPSKFSGSGSGTDFTLTISS LQPEDFATYYCQQYNSYPYTFAQGTKLEIKRTVAAPSVFI FPPSDEQLKSGTASVVCLLNNFYPREAKVQWKVDNALQS GNSQESVTEQDSKDSTYSLSSTLTLSKADYEKHKVYACE VTHQGLSSPVTKSFNRGEC |
| DL3B279-LH-scFv | 694 | DIQMTQSPSSLSASVGDRVTITCRASQGISNYLAW FQQKPGKAPKSLIYAASSLQSGVPSKFSGSGSGTDFTLTISS LQPEDFATYYCQQYNSYPYTFAQGTKLEIKGGSEGKSSGS GSESKSTGGSQVQLVQSGAEVKKPGASVKVSCKASGNTF TNYYTHWVRQAPGQGLEWMGIINPSGGSTSYAQKLQGR MTMTRDTSTSTVYMELSSLRSEDTAVYFCARQGPFIGDAF DIWGQGTMVTVSSEPKSSDKTHTCPPCPAPEAAGGPSVFL FPPKPKDTLMISRTPEVTCVVVSVSHEDPEVKFNWYVDG VEVHNAKTKPREEQYNSTYRVVSVLTVLHQDWLNGKEY KCKVSNKALPAPIEKTISKAKGQPREPQVYVLPPSREEMT KNQVSLLCLVKGFYPSDIAVEWESNGQPENNYLTWPPVL DSDGSFFLYSKLTVDKSRWQQGNVFSCSVMHEALHNHY TQKSLSLS |
| DL3B279-VL-A99G-VH-N27Q_M105T-LH-scFv-Fc (ZW) | 695 | DIQMTQSPSSLSASVGDRVTITCRASQGISNYLAW FQQKPGKAPKSLIYAASSLQSGVPSKFSGSGSGTDFTLTISS LQPEDFATYYCQQYNSYPYTFGQGTKLEIKGGSEGKSSGS GSESKSTGGSQVQLVQSGAEVKKPGASVKVSCKASGQTF TNYYIHWVRQAPGQGLEWMGIINPSGGSTSYAQKLQGR MTMTRDTSTSTVYMELSSLRSEDTAVYFCARQGPFIGDAF DIWGQGTTVTVSSEPKSSDKTHTCPPCPAPEAAGGPSVFL FPPKPKDTLMISRTPEVTCVVVSVSHEDPEVKFNWYVDG VEVHNAKTKPREEQYNSTYRVVSVLTVLHQDWLNGKEY KCKVSNKALPAPIEKTISKAKGQPREPQVYVLPPSREEMT KNQVSLLCLVKGFYPSDIAVEWESNGQPENNYLTWPPVL DSDGSFFLYSKLTVDKSRWQQGNVFSCSVMHEALHNHY TQKSLSLSPGK |
| CD3W245-LH-scFv-Fc | 78 | DIQMTQSPSSLSASVGDRVTITCRARQSIGTAIHWY QQKPGKAPKLLIKYASESISGVPSRFSGSGSGTDFTLTISSL QPEDFATYYCQQSGSWPYTFGQGTKLEIKGGSEGKSSGSG SESKSTGGSEVQLVESGGGLVKPGGSLRLSCAASGFTFSR YNMNWVRQAPGKGLEWVSSISTSSNYIYYADSVKGRFTF SRDNAKNSLDLQMSGLRAEDTAIYYCTRGWGPFDYWGQ GTLVTVSSEPKSSDKTHTCPPCPAPEAAGGPSVFLFPPKPK DTLMISRTPEVTCVVVSVSHEDPEVKFNWYVDGVEVHNA KTKPREEQYNSTYRVVSVLTVLHQDWLNGKEYKCKVSN KALPAPIEKTISKAKGQPREPQVYVYPPSREEMTKNQVSL TCLVKGFYPSDIAVEWESNGQPENNYKTTPPVLDSDGSFA LVSKLTVDKSRWQQGNVFSCSVMHEALHNHYTQKSLSLS PG |
| CD3W245-HL-scFv-Fc | 77 | EVQLVESGGGLVKPGGSLRLSCAASGFTFSRYNM NWVRQAPGKGLEWVSSISTSSNYIYYADSVKGRFTFSRD NAKNSLDLQMSGLRAEDTAIYYCTRGWGPFDYWGQGTL VTVSSGGSEGKSSGSGSESKSTGGSDIQMTQSPSSLSASVG DRVTITCRARQSIGTAIHWYQQKPGKAPKLLIKYASESISG VPSRFSGSGSGTDFTLTISSLQPEDFATYYCQQSGSWPYTF GQGTKLEIKEPKSSDKTHTCPPCPAPEAAGGPSVFLFPPKP KDTLMISRTPEVTCVVVSVSHEDPEVKFNWYVDGVEVHN AKTKPREEQYNSTYRVVSVLTVLHQDWLNGKEYKCKVS NKALPAPIEKTISKAKGQPREPQVYVYPPSREEMTKNQVS LTCLVKGFYPSDIAVEWESNGQPENNYKTTPPVLDSDGSF ALVSKLTVDKSRWQQGNVFSCSVMHEALHNHYTQKSLS LSPG |
| CD3W245-Fab-Fc HC2 | 85 | EVQLVESGGGLVKPGGSLRLSCAASGFTFSRYNM NWVRQAPGKGLEWVSSISTSSNYIYYADSVKGRFTFSRD NAKNSLDLQMSGLRAEDTAIYYCTRGWGPFDYWGQGTL VTVSSASTKGPSVFPLAPSSKSTSGGTAALGCLVKDYFPEP VTVSWNSGALTSGVHTFPAVLQSSGLYSLSSVVTVPSSSL GTQTYICNVNHKPSNTKVDKKVEPKSCDKTHTCPPCPAPE |

TABLE 75-continued

Amino acid sequences of selected bispecific antibodies

| Protein | SEQ ID NO: | Amino acid sequence |
|---|---|---|
| | | AAGGPSVFLFPPKPKDTLMISRTPEVTCVVVSVSHEDPEV KFNWYVDGVEVHNAKTKPREEQYNSTYRVVSVLTVLHQ DWLNGKEYKCKVSNKALPAPIEKTISKAKGQPREPQVYV YPPSREEMTKNQVSLTCLVKGFYPSDIAVEWESNGQPEN NYKTTPPVLDSDGSFALVSKLTVDKSRWQQGNVFSCSVM HEALHNHYTQKSLSLSPG |
| CD3W245-Fab-Fc LC2 | 88 | DIQMTQSPSSLSASVGDRVTITCRARQSIGTAIHWY QQKPGKAPKLLIKYASESISGVPSRFSGSGSGTDFTLTISSL QPEDFATYYCQQSGSWPYTFGQGTKLEIKRTVAAPSVFIF PPSDEQLKSGTASVVCLLNNFYPREAKVQWKVDNALQSG NSQESVTEQDSKDSTYSLSSTLTLSKADYEKHKVYACEVT HQGLSSPVTKSFNRGEC |
| CD3B376-Fab-Fc HC2 | 349 | QVQLQQSGPRLVRPSQTLSLTCAISGDSVFNNNAA WSWIRQSPSRGLEWLGRTYYRSKWLYDYAVSVKSRITVN PDTSRNQFTLQLNSVTPEDTALYYCARGYSSSFDYWGQG TLVTVSSASTKGPSVFPLAPSSKSTSGGTAALGCLVKDYFP EPVTVSWNSGALTSGVHTFPAVLQSSGLYSLSSVVTVPSS SLGTQTYICNVNHKPSNTKVDKKVEPKSCDKTHTCPPCPA PEAAGGPSVFLFPPKPKDTLMISRTPEVTCVVVSVSHEDPE VKFNWYVDGVEVHNAKTKPREEQYNSTYRVVSVLTVLH QDWLNGKEYKCKVSNKALPAPIEKTISKAKGQPREPQVY VYPPSREEMTKNQVSLTCLVKGFYPSDIAVEWESNGQPE NNYKTTPPVLDSDGSFALVSKLTVDKSRWQQGNVFSCSV MHEALHNHYTQKSLSLSPG |
| CD3B376-Fab-Fc LC2 | 350 | QSALTQPASVSGSPGQSITISCTGTSSNIGTYKFVS WYQQHPDKAPKVLLYEVSKRPSGVSSRFSGSKSGNTASL TISGLQAEDQADYHCVSYAGSGTLLFGGGTKLTVLGQPK AAPSVTLFPPSSEELQANKATLVCLISDFYPGAVTVAWKA DSSPVKAGVETTTPSKQSNNKYAASSYLSLTPEQWKSHRS YSCQVTHEGSTVEKTVAPTECS |
| CD3B376-Fab-Fc K477 HC2 | 696 | QVQLQQSGPRLVRPSQTLSLTCAISGDSVFNNNAA WSWIRQSPSRGLEWLGRTYYRSKWLYDYAVSVKSRITVN PDTSRNQFTLQLNSVTPEDTALYYCARGYSSSFDYWGQG TLVTVSSASTKGPSVFPLAPSSKSTSGGTAALGCLVKDYFP EPVTVSWNSGALTSGVHTFPAVLQSSGLYSLSSVVTVPSS SLGTQTYICNVNHKPSNTKVDKKVEPKSCDKTHTCPPCPA PEAAGGPSVFLFPPKPKDTLMISRTPEVTCVVVSVSHEDPE VKFNWYVDGVEVHNAKTKPREEQYNSTYRVVSVLTVLH QDWLNGKEYKCKVSNKALPAPIEKTISKAKGQPREPQVY VYPPSREEMTKNQVSLTCLVKGFYPSDIAVEWESNGQPE NNYKTTPPVLDSDGSFALVSKLTVDKSRWQQGNVFSCSV MHEALHNHYTQKSLSLSPGK |
| CD3B376-Fab-K477 LC2 | 350 | QSALTQPASVSGSPGQSITISCTGTSSNIGTYKFVS WYQQHPDKAPKVLLYEVSKRPSGVSSRFSGSKSGNTASL TISGLQAEDQADYHCVSYAGSGTLLFGGGTKLTVLGQPK AAPSVTLFPPSSEELQANKATLVCLISDFYPGAVTVAWKA DSSPVKAGVETTTPSKQSNNKYAASSYLSLTPEQWKSHRS YSCQVTHEGSTVEKTVAPTECS |
| DL3B279-VL-A99G-VH-N27Q_M105T-LH-scFv-Fc (KIH) | 697 | DIQMTQSPSSLSASVGDRVTITCRASQGISNYLAW FQQKPGKAPKSLIYAASSLQSGVPSKFSGSGSGTDFTLTISS LQPEDFATYYCQQYNSYPYTFGQGTKLEIKGGSEGKSSGS GSESKSTGGSQVQLVQSGAEVKKPGASVKVSCKASGQTF TNYYIHWVRQAPGQGLEWMGIINPSGGSTSYAQKLQGR MTMTRDTSTSTVYMELSSLRSEDTAVYFCARQGPFIGDAF DIWGQGTTVTVSSEPKSSDKTHTCPPCPAPEAAGGPSVFL FPPKPKDTLMISRTPEVTCVVVSVSHEDPEVKFNWYVDG VEVHNAKTKPREEQYNSTYRVVSVLTVLHQDWLNGKEY KCKVSNKALPAPIEKTISKAKGQPREPQVYTLPPSREEMT KNQVSLWCLVKGFYPSDIAVEWESNGQPENNYKTTPPVL DSDGSFFLYSKLTVDKSRWQQGNVFSCSVMHEALHNHY TQKSLSLSPGK |
| CD3B376-Fab-Fc HC2 | 727 | QVQLQQSGPRLVRPSQTLSLTCAISGDSVFNNNAA WSWIRQSPSRGLEWLGRTYYRSKWLYDYAVSVKSRITVN PDTSRNQFTLQLNSVTPEDTALYYCARGYSSSFDYWGQG TLVTVSSASTKGPSVFPLAPSSKSTSGGTAALGCLVKDYFP EPVTVSWNSGALTSGVHTFPAVLQSSGLYSLSSVVTVPSS SLGTQTYICNVNHKPSNTKVDKKVEPKSCDKTHTCPPCPA PEAAGGPSVFLFPPKPKDTLMISRTPEVTCVVVSVSHEDPE VKFNWYVDGVEVHNAKTKPREEQYNSTYRVVSVLTVLH |

TABLE 75-continued

| Amino acid sequences of selected bispecific antibodies | | |
|---|---|---|
| Protein | SEQ ID NO: | Amino acid sequence |
| | | QDWLNGKEYKCKVSNKALPAPIEKTISKAKGQPREPQVY TLPPSREEMTKNQVSLSCAVKGFYPSDIAVEWESNGQPEN NYKTTPPVLDSDGSFFLVSKLTVDKSRWQQGNVFSCSVM HEALHNRFTQKSLSLSPGK |

TABLE 76

| Kabat CDR SEQ ID NOs of bispecific DLL3/CD3 antibodies | | | | | | | |
|---|---|---|---|---|---|---|---|
| Bispecific antibody | Parental (DLL3 arm/CD3 arm) | HCDR1 (SEQ ID No) | HCDR2 (SEQ ID No) | HCDR3 (SEQ ID No) | LCDR1 (SEQ ID No) | LCDR2 (SEQ ID No) | LCDR3 (SEQ ID No) |
| DL3B582 | DL3B279-Fab | NYYIH (699) | IINPSGG STSYAQ KLQG (700) | QGPFIG DAFDI (701) | RASQG ISNYL A (702) | AASSL QS (703) | QQYNS YPYT (704) |
| | CD3W245 LH-scFv | RYNMN (6) | SISTSSN YIYYA DSVKG (7) | GWGPF DY (8) | RARQS IGTAIH (9) | YASESI S (10) | QQSGS WPYT (11) |
| DL3B583 | DL3B279 Fab | NYYIH (699) | IINPSGG STSYAQ KLQG (700) | QGPFIG DAFDI (701) | RASQG ISNYL A (702) | AASSL QS (703) | QQYNS YPYT (704) |
| | CD3W245-HL-scFv | RYNMN (6) | SISTSSN YIYYA DSVKG (7) | GWGPF DY (8) | RARQS IGTAIH (9) | YASESI S (10) | QQSGS WPYT (11) |
| DL3B585 | DL3B279-LH-scFv | NYYIH (699) | IINPSGG STSYAQ KLQG (700) | QGPFIG DAFDI (701) | RASQG ISNYL A (702) | AASSL QS (703) | QQYNS YPYT (704) |
| | CD3B376-Fab | NNNAA WS 340 | RTYYRS KWLYD YAYSY KS 341 | GYSSSF DY 342 | TGTSS NIGTY KFVS 343 | EVSKR PS 344 | VSYAG SGTLL 345 |
| DL3B587 | DL3B279-scFv | NYYIH (699) | IINPSGG STSYAQ KLQG (700) | QGPFIG DAFDI (701) | RASQG ISNYL A (702) | AASSL QS (703) | QQYNS YPYT (704) |
| | CD3W245-Fab | RYNMN (6) | SISTSSN YIYYA DSVKG (7) | GWGPF DY (8) | RARQS IGTAIH (9) | YASESI S (10) | QQSGS WPYT (11) |
| D3C3B80 | DL3B279-VL-A99G-VH-N27Q_M105T-LH-scFv (ZWB) | NYYIH (699) | IINPSGG STSYAQ KLQG (700) | QGPFIG DAFDI (701) | RASQG ISNYL A (702) | AASSL QS (703) | QQYNS YPYT (704) |
| | CD3B376-K477-Fab | NNNAA WS 340 | RTYYRS KWLYD YAYSY KS 341 | GYSSSF DY 342 | TGTSS NIGTY KFVS 343 | EVSKR PS 344 | VSYAG SGTLL 345 |
| D3C3BB3 | DL3B279-VL-A99G-VH-N27Q_M105T-LH-scFv (KIH) | NYYIH (699) | IINPSGG STSYAQ KLQG (700) | QGPFIG DAFDI (701) | RASQG ISNYL A (702) | AASSL QS (703) | QQYNS YPYT (704) |
| | CD3B376-Fab (KIH) | NNNAA WS 340 | RTYYRS KWLYD YAYSY KS 341 | GYSSSF DY 342 | TGTSS NIGTY KFVS 343 | EVSKR PS 344 | VSYAG SGTLL 345 |

TABLE 77

HC and LC DNA SEQ ID NOs of DLL3/CD3 bispecific antibodies

| | DLL3 arm | | | CD3 arm | | |
|---|---|---|---|---|---|---|
| Bispecific Name | Name | HC1 or scFv-Fc SEQ ID NO: | LC1 SEQ ID NO: | Name | HC2 or scFv-Fc SEQ ID NO: | LC2 SEQ ID NO: |
| DL3B582 | DL3B279-Fab-Fc | 705 | 706 | CD3W245-LH-scFv-Fc | 710 | |
| DL3B583 | DL3B279-Fab-Fc | 705 | 706 | CD3W245-HL-scFv-Fc | 711 | |
| DL3B585 | DL3B279-LH-scFv-Fc | 707 | | CD3B376-Fab-Fc | 351 | 352 |
| DL3B587 | DL3B279-LH-scFv-Fc | 707 | | CD3W245-Fab-Fc | 712 | 713 |
| D3C3B80 | DL3B279-VL-A99G-VH-N27Q_M105T-LH-scFv (ZWB) | 708 | | CD3B376-K477-Fab-Fc | 351 | 352 |
| D3C3BB3 | DL3B279-scFv-Fc (KIH) | 709 | | CD3B376-Fab-Fc (KIH) | 714 | 715 |

>SEQ ID NO: 705 (DL3B279-Fab-Fc HC1 cDNA in DL3B582 and DL3B583)
CAGGTTCAGTTGGTCCAGAGTGGTGCCGAAGTAAAGAAGCCCGGAGCATCCGTAAA
GGTGTCCTGTAAAGCCAGTGGCAATACTTTCACTAACTATTACATCCATTGGGTCCGACAAG
CCCCCGGACAAGGATTGGAGTGGATGGGTATTATCAACCCCTCCGGTGGGTCTACTTCTTAC
GCTCAAAAACTCCAGGGCCGAATGACAATGACACGCGACACCTCAACTTCAACCGTTTACAT
GGAGCTTAGCAGTCTTCGATCTGAGGACACTGCTGTTTACTTTTGCGCTAGGCAGGGGCCTTT
CATAGGAGACGCTTTTGACATCTGGGGGCAAGGAACAATGGTCACTGTCAGTTCCGCCTCCA
CCAAGGGCCCATCGGTCTTCCCCCTGGCACCCTCCTCCAAGAGCACCTCTGGGGGCACAGCG
GCCCTGGGCTGCCTGGTCAAGGACTACTTCCCCGAACCGGTGACGGTGTCGTGGAACTCAGG
CGCCCTGACCAGCGGCGTGCACACCTTCCCGGCTGTCCTACAGTCCTCAGGACTCTACTCCCT
CAGCAGCGTGGTGACCGTGCCCTCCAGCAGCTTGGGCACCCAGACCTACATCTGCAACGTGA
ATCACAAGCCCAGCAACACCAAGGTGGACAAGAAAGTTGAGCCCAAATCTTGTGACAAAAC
TCACACATGTCCACCGTGCCCAGCACCTGAAGCAGCAGGGGGACCGTCAGTCTTCCTCTTCC
CCCCAAAACCCAAGGACACCCTCATGATCTCCCGGACCCCTGAGGTCACATGCGTGGTGGTG
AGCGTGAGCCACGAAGACCCTGAGGTCAAGTTCAACTGGTACGTGGACGGCGTGGAGGTGC
ATAATGCCAAGACAAAGCCGCGGGAGGAGCAGTACAACAGCACGTACCGTGTGGTCAGCGT
CCTCACCGTCCTGCACCAGGACTGGCTGAATGGCAAGGAGTACAAGTGCAAGGTCTCCAAC
AAAGCCCTCCCAGCCCCCATCGAGAAAACCATCTCCAAAGCCAAAGGGCAGCCCCGAGAAC
CACAGGTGTACGTGCTGCCCCCATCCCGGGAGGAGATGACCAAGAACCAGGTCAGCCTGCT
GTGCCTGGTCAAAGGCTTCTATCCCAGCGACATCGCCGTGGAGTGGGAGAGCAATGGGCAG
CCGGAGAACAACTACCTCACCTGGCCTCCCGTGCTGGACTCCGACGGCTCCTTCTTCCTCTAC
AGCAAGCTCACCGTGGACAAGTCTAGATGGCAGCAGGGGAACGTCTTCTCATGCTCCGTGAT
GCATGAGGCTCTGCACAACCACTACACGCAGAAGAGCCTCTCCCTGTCTCCGGGT >SEQ ID NO: 706 ( DL3B279-Fab-Fc LC1 cDNA in DL3B582 and DL3B583)
GACATCCAGATGACCCAGAGCCCTAGCTCTTTAAGCGCTAGCGTGGGCGATCGTGTG
ACCATCACTTGTCGTGCCAGCCAAGGTATCAGCAACTATTTAGCTTGGTTCCAGCAGAAGCC
CGGCAAGGCTCCCAAGTCTTTAATCTATGCCGCTAGCTCTTTACAGAGCGGAGTGCCCAGCA
AGTTTAGCGGCAGCGGTAGCGGAACCGACTTCACTTTAACCATCAGCTCTCTGCAGCCCGAG
GACTTCGCCACCTACTACTGCCAGCAGTACAACAGCTACCCCTACACCTTCGCCCAAGGTAC
CAAGCTGGAGATCAAGCGTACGGTGGCTGCACCATCTGTCTTCATCTTCCCGCCATCTGATG
AGCAGTTGAAATCTGGAACTGCCTCTGTTGTGTGCCTGCTGAATAACTTCTATCCCAGAGAG
GCCAAAGTACAGTGGAAGGTGGATAACGCCCTCCAATCGGGTAACTCCCAGGAGAGTGTCA
CAGAGCAGGACAGCAAGGACAGCACCTACAGCCTCAGCAGCACCCTGACGCTGAGCAAAGC
AGACTACGAGAAACACAAAGTCTACGCCTGCGAAGTCACCCATCAGGGCCTGAGCTCGCCC
GTCACAAAGAGCTTCAACAGGGGAGAGTGT >SEQ ID NO: 707 (DL3B279 LH scFv-Fc cDNA in DL3B585 and DL3B587)
GATATTCAGATGACACAGTCTCCATCCAGCTTGTCAGCAAGCGTGGGTGATAGGGTT
ACCATCACTTGTCGCGCAAGTCAAGGAATTAGTAACTATTTGGCATGGTTTCAGCAGAAACC
CGGTAAGGCTCCAAAATCACTCATATATGCAGCATCCTCCCTCCAGTCTGGTGTTCCAAGTA
AGTTTTCCGGGAGCGGTTCCGGCACCGATTTCACTCTCACAATCTCTAGCCTTCAACCCGAG
GACTTCGCTACCTATTATTGCCAACAGTATAATAGCTACCCATACACTTTTGCTCAAGGGACC
AAACTCGAGATCAAAGGCGGCTCCGAGGGCAAGAGCAGCGGCAGCGGCAGCGAGAGCAAG
AGCACCGGCGGCAGCCAGGTTCAGTTGGTCCAGAGTGGTGCCGAAGTAAAGAAGCCCGGAG
CATCCGTAAAGGTGTCCTGTAAAGCCAGTGGCAATACTTTCACTAACTATTACATCCATTGG
GTCCGACAAGCCCCCGGACAAGGATTGGAGTGGATGGGTATTATCAACCCCTCCGGTGGGTC
TACTTCTTACGCTCAAAAACTCCAGGGCCGAATGACAATGACACGCGACACCTCAACTTCAA
CCGTTTACATGGAGCTTAGCAGTCTTCGATCTGAGGACACTGCTGTTTACTTTTGCGCTAGGC
AGGGGCCTTTCATAGGAGACGCTTTTGACATCTGGGGGCAAGGAACAATGGTCACTGTCAGT
TCCGAGCCCAAATCTAGCGACAAAACTCACACATGTCCACCGTGCCCAGCACCTGAAGCAG TABLE 77-continued HC and LC DNA SEQ ID NOs of DLL3/CD3 bispecific antibodies CAGGGGGACCGTCAGTCTTCCTCTTCCCCCCAAAACCCAAGGACACCCTCATGATCTCCCGG
ACCCCTGAGGTCACATGCGTGGTGGTGAGCGTGAGCCACGAAGACCCTGAGGTCAAGTTCA
ACTGGTACGTGGACGGCGTGGAGGTGCATAATGCCAAGACAAAGCCGCGGGAGGAGCAGTA
CAACAGCACGTACCGTGTGGTCAGCGTCCTCACCGTCCTGCACCAGGACTGGCTGAATGGCA
AGGAGTACAAGTGCAAGGTCTCCAACAAAGCCCTCCCAGCCCCCATCGAGAAAACCATCTC
CAAAGCCAAAGGGCAGCCCCGAGAACCACAGGTGTACGTGCTGCCCCCATCCCGGGAGGAG
ATGACCAAGAACCAGGTCAGCCTGCTGTGCCTGGTCAAAGGCTTCTATCCCAGCGACATCGC
CGTGGAGTGGGAGAGCAATGGGCAGCCGGAGAACAACTACCTCACCTGGCCTCCCGTGCTG
GACTCCGACGGCTCCTTCTTCCTCTACAGCAAGCTCACCGTGGACAAGTCTAGATGGCAGCA
GGGGAACGTCTTCTCATGCTCCGTGATGCATGAGGCTCTGCACAACCACTACACGCAGAAGA
GCCTCTCCCTGTCTCCGGGT >SEQ ID NO: 708 (DL3B279 LH scFv variant-Fc cDNA)
GACATCCAGATGACCCAGTCTCCATCCTCTCTGTCCGCCTCTGTGGGCGACAGAGTG
ACCATCACCTGTAGAGCCTCTCAGGGCATCTCCAACTACCTGGCCTGGTTCCAGCAGAAGCC
TGGCAAGGCTCCCAAGAGCCTGATCTACGCTGCTTCCAGTCTGCAGTCTGGCGTGCCCTCTA
AGTTCTCCGGCTCTGGCTCTGGCACCGACTTTACCCTGACAATCTCCAGCCTGCAGCCTGAG
GACTTCGCCACCTACTACTGCCAGCAGTACAACAGCTACCCCTACACCTTTGGCCAGGGCAC
CAAGCTGGAAATCAAGGGCGGCTCCGAGGGCAAGAGCAGCGGCAGCGGCAGCGAGAGCAA
GAGCACCGGCGGCAGCCAGGTTCAGCTGGTTCAGTCTGGCGCCGAAGTGAAGAAACCTGGC
GCCTCTGTGAAGGTGTCCTGCAAGGCTTCTGGACAGACCTTCACCAACTACTACATCCACTG
GGTCCGACAGGCCCCTGGACAAGGATTGGAGTGGATGGGCATCATCAACCCTTCCGGCGGC
TCTACCTCTTACGCCCAGAAACTGCAGGGCAGAATGACCATGACCAGAGACACCTCCACCA
GCACCGTGTACATGGAACTGTCCAGCCTGAGATCCGAGGATACCGCCGTGTACTTCTGTGCC
AGACAGGGACCTTTTATCGGCGACGCCTTCGACATCTGGGGCCAGGGAACAACAGTGACCG
TGTCCTCTGAGCCCAAATCTAGCGACAAAACTCACACTTGTCCACCGTGCCCAGCACCTGAA
GCAGCAGGGGGACCGTCAGTCTTCCTCTTCCCCCCAAAACCCAAGGACACCCTCATGATCTC
CCGGACCCCTGAGGTCACATGCGTGGTGGTGAGCGTGAGCCACGAAGACCCTGAGGTCAAG
TTCAACTGGTACGTGGACGGCGTGGAGGTGCATAATGCCAAGACAAAGCCGCGGGAGGAGC
AGTACAACAGCACGTACCGTGTGGTCAGCGTCCTCACCGTCCTGCACCAGGACTGGCTGAAT
GGCAAGGAGTACAAGTGCAAGGTGTCCAACAAAGCCCTCCCAGCCCCCATCGAGAAAACCA
TCTCCAAAGCCAAAGGGCAGCCCCGAGAACCACAGGTGTACGTGCTGCCCCCATCCCGGGA
GGAGATGACCAAGAACCAGGTCAGCCTGCTGTGCCTGGTCAAAGGCTTCTATCCCAGCGAC
ATCGCCGTGGAGTGGGAGAGCAATGGGCAGCCGGAGAACAACTACCTCACCTGGCCTCCCG
TGCTGGACTCCGACGGCTCCTTCTTCCTCTACAGCAAGCTCACCGTGGACAAGTCCAGATGG
CAGCAGGGGAACGTCTTCTCATGCTCCGTGATGCATGAGGCTCTGCACAACCACTACACGCA
GAAGTCTCTCTCCCTGTCTCCGGGAAAA >SEQ ID NO: 709 (DL3B279 scFv-Fc variant KIH cDNA)
GACATCCAGATGACCCAGTCTCCATCCTCTCTGTCCGCCTCTGTGGGCGACAGAGTG
ACCATCACCTGTAGAGCCTCTCAGGGCATCTCCAACTACCTGGCCTGGTTCCAGCAGAAGCC
TGGCAAGGCTCCCAAGAGCCTGATCTACGCTGCTTCCAGTCTGCAGTCTGGCGTGCCCTCTA
AGTTCTCCGGCTCTGGCTCTGGCACCGACTTTACCCTGACAATCTCCAGCCTGCAGCCTGAG
GACTTCGCCACCTACTACTGCCAGCAGTACAACAGCTACCCCTACACCTTTGGCCAGGGCAC
CAAGCTGGAAATCAAGGGCGGCTCCGAGGGCAAGAGCAGCGGCAGCGGCAGCGAGAGCAA
GAGCACCGGCGGCAGCCAGGTTCAGCTGGTTCAGTCTGGCGCCGAAGTGAAGAAACCTGGC
GCCTCTGTGAAGGTGTCCTGCAAGGCTTCTGGACAGACCTTCACCAACTACTACATCCACTG
GGTCCGACAGGCCCCTGGACAAGGATTGGAGTGGATGGGCATCATCAACCCTTCCGGCGGC
TCTACCTCTTACGCCCAGAAACTGCAGGGCAGAATGACCATGACCAGAGACACCTCCACCA
GCACCGTGTACATGGAACTGTCCAGCCTGAGATCCGAGGATACCGCCGTGTACTTCTGTGCC
AGACAGGGACCTTTTATCGGCGACGCCTTCGACATCTGGGGCCAGGGAACAACAGTGACCG
TGTCCTCTGAGCCCAAATCTAGCGACAAAACTCACACATGTCCACCGTGCCCAGCACCTGAA
GCAGCAGGGGGACCGTCAGTCTTCCTCTTCCCCCCAAAACCCAAGGACACCCTCATGATCTC
CCGGACCCCTGAGGTCACATGCGTGGTGGTGAGCGTGAGCCACGAAGACCCTGAGGTCAAG
TTCAACTGGTACGTGGACGGCGTGGAGGTGCATAATGCCAAGACAAAGCCGCGGGAGGAGC
AGTACAACAGCACGTACCGTGTGGTCAGCGTCCTCACCGTCCTGCACCAGGACTGGCTGAAT
GGCAAGGAGTACAAGTGCAAGGTCTCCAACAAAGCCCTCCCAGCCCCCATCGAGAAAACCA
TCTCCAAAGCCAAAGGGCAGCCCCGAGAACCACAGGTGTACACCCTGCCCCCATCCCGGGA
GGAGATGACCAAGAACCAGGTCAGCCTGTGGTGCCTGGTCAAAGGCTTCTATCCCAGCGAC
ATCGCCGTGGAGTGGGAGAGCAATGGGCAGCCGGAGAACAACTACAAGACCACGCCTCCCG
TGCTGGACTCCGACGGCTCCTTCTTCCTCTACAGCAAGCTCACCGTGGACAAGTCTAGATGG
CAGCAGGGGAACGTCTTCTCATGCTCCGTGATGCATGAGGCTCTGCACAACCACTACACGCA
GAAGAGCCTCTCCCTGTCTCCGGGTAAA >SEQ ID NO: 710 (CD3W245 LH scFv-Fc cDNA)
GACATACAAATGACACAATCACCCTCTTCTCTTTCTGCAAGCGTTGGCGACCGTGTCA
CTATCACTTGTCGAGCCCGCCAGTCCATAGGTACTGCCATTCACTGGTATCAACAGAAGCCT
GGCAAGGCTCCCAAACTCCTGATTAAGTATGCCAGCGAGAGCATTTCCGGCGTACCTTCAAG
ATTTTCCGGCTCCGGTAGTGGGACAGATTTCACTCTCACTATATCTAGCCTCCAACCAGAAG
ATTTCGCCACTTACTACTGTCAACAATCAGGTTCATGGCCTTACACTTTCGGCCAGGGGACA
AAATTGGAGATCAAGGGCGGCTCCGAGGGCAAGAGCAGCGGCAGCGGCAGCGAGAGCAAG
AGCACCGGCGGCAGCGAGGTGCAACTGGTGGAGTCTGGGGGAGGCCTGGTCAAGCCTGGGG
GGTCCCTGAGACTCTCCTGTGCAGCCTCTGGATTCACCTTCAGTAGATATAACATGAACTGG
GTCCGCCAGGCTCCAGGGAAGGGGCTGGAGTGGGTCTCATCCATTAGTACTAGTAGTAATTA
CATATACTACGCAGACTCAGTGAAGGGCCGATTCACCTTCTCCAGAGACAACGCCAAGAACT
CACTGGATCTGCAAATGAGCGGCCTGAGAGCCGAGGACACGGCTATTTATTACTGTACGAG
AGGCTGGGGGCCTTTTGACTACTGGGGCCAGGGAACCCTGGTCACCGTCTCCTCAGAGCCCA
AATCTAGCGACAAAACTCACACATGTCCACCGTGCCCAGCACCTGAAGCAGCAGGGGGACC TABLE 77-continued HC and LC DNA SEQ ID NOs of DLL3/CD3 bispecific antibodies GTCAGTCTTCCTCTTCCCCCCAAAACCCAAGGACACCCTCATGATCTCCCGGACCCCTGAGG
TCACATGCGTGGTGGTGAGCGTGAGCCACGAAGACCCTGAGGTCAAGTTCAACTGGTACGT
GGACGGCGTGGAGGTGCATAATGCCAAGACAAAGCCGCGGGAGGAGCAGTACAACAGCAC
GTACCGTGTGGTCAGCGTCCTCACCGTCCTGCACCAGGACTGGCTGAATGGCAAGGAGTACA
AGTGCAAGGTCTCCAACAAAGCCCTCCCAGCCCCCATCGAGAAAACCATCTCCAAAGCCAA
AGGGCAGCCCCGAGAACCACAGGTGTACGTGTACCCCCCATCCCGGGAGGAGATGACCAAG
AACCAGGTCAGCCTGACCTGCCTGGTCAAAGGCTTCTATCCCAGCGACATCGCCGTGGAGTG
GGAGAGCAATGGGCAGCCGGAGAACAACTACAAGACCACGCCTCCCGTGCTGGACTCCGAC
GGCTCCTTCGCCCTCGTGAGCAAGCTCACCGTGGACAAGTCTAGATGGCAGCAGGGGAACG
TCTTCTCATGCTCCGTGATGCATGAGGCTCTGCACAACCACTACACGCAGAAGAGCCTCTCC
CTGTCTCCGGGT >SEQ ID NO: 711 (CD3W245 HL scFv-Fc cDNA)
GAGGTGCAACTGGTGGAGTCTGGGGGAGGCCTGGTCAAGCCTGGGGGGTCCCTGAG
ACTCTCCTGTGCAGCCTCTGGATTCACCTTCAGTAGATATAACATGAACTGGGTCCGCCAGG
CTCCAGGGAAGGGGCTGGAGTGGGTCTCATCCATTAGTACTAGTAGTAATTACATATACTAC
GCAGACTCAGTGAAGGGCCGATTCACCTTCTCCAGAGACAACGCCAAGAACTCACTGGATCT
GCAAATGAGCGGCCTGAGAGCCGAGGACACGGCTATTTATTACTGTACGAGAGGCTGGGGG
CCTTTTGACTACTGGGGCCAGGGAACCCTGGTCACCGTCTCCTCAGGCGGCTCCGAGGGCAA
GAGCAGCGGCAGCGGCAGCGAGAGCAAGAGCACCGGCGGCAGCGACATACAAATGACACA
ATCACCCTCTTCTCTTTCTGCAAGCGTTGGCGACCGTGTCACTATCACTTGTCGAGCCCGCCA
GTCCATAGGTACTGCCATTCACTGGTATCAACAGAAGCCTGGCAAGGCTCCCAAACTCCTGA
TTAAGTATGCCAGCGAGAGCATTTCCGGCGTACCTTCAAGATTTTCCGGCTCCGGTAGTGGG
ACAGATTTCACTCTCACTATATCTAGCCTCCAACCAGAAGATTTCGCCACTTACTACTGTCAA
CAATCAGGTTCATGGCCTTACACTTTCGGCCAGGGGACAAAATTGGAGATCAAGGAGCCCA
AATCTAGCGACAAAACTCACACATGTCCACCGTGCCCAGCACCTGAAGCAGCAGGGGGACC
GTCAGTCTTCCTCTTCCCCCCAAAACCCAAGGACACCCTCATGATCTCCCGGACCCCTGAGG
TCACATGCGTGGTGGTGAGCGTGAGCCACGAAGACCCTGAGGTCAAGTTCAACTGGTACGT
GGACGGCGTGGAGGTGCATAATGCCAAGACAAAGCCGCGGGAGGAGCAGTACAACAGCAC
GTACCGTGTGGTCAGCGTCCTCACCGTCCTGCACCAGGACTGGCTGAATGGCAAGGAGTACA
AGTGCAAGGTCTCCAACAAAGCCCTCCCAGCCCCCATCGAGAAAACCATCTCCAAAGCCAA
AGGGCAGCCCCGAGAACCACAGGTGTACGTGTACCCCCCATCCCGGGAGGAGATGACCAAG
AACCAGGTCAGCCTGACCTGCCTGGTCAAAGGCTTCTATCCCAGCGACATCGCCGTGGAGTG
GGAGAGCAATGGGCAGCCGGAGAACAACTACAAGACCACGCCTCCCGTGCTGGACTCCGAC
GGCTCCTTCGCCCTCGTGAGCAAGCTCACCGTGGACAAGTCTAGATGGCAGCAGGGGAACG
TCTTCTCATGCTCCGTGATGCATGAGGCTCTGCACAACCACTACACGCAGAAGAGCCTCTCC
CTGTCTCCGGGT >SEQ ID NO: 712 (CD3W245 Fab-Fc HC2 cDNA)
GAGGTGCAACTGGTGGAGTCTGGGGGAGGCCTGGTCAAGCCTGGGGGGTCCCTGAG
ACTCTCCTGTGCAGCCTCTGGATTCACCTTCAGTAGATATAACATGAACTGGGTCCGCCAGG
CTCCAGGGAAGGGGCTGGAGTGGGTCTCATCCATTAGTACTAGTAGTAATTACATATACTAC
GCAGACTCAGTGAAGGGCCGATTCACCTTCTCCAGAGACAACGCCAAGAACTCACTGGATCT
GCAAATGAGCGGCCTGAGAGCCGAGGACACGGCTATTTATTACTGTACGAGAGGCTGGGGG
CCTTTTGACTACTGGGGCCAGGGAACCCTGGTCACCGTCTCCTCAGCCTCCACCAAGGGCCC
ATCGGTCTTCCCCCTGGCACCCTCCTCCAAGAGCACCTCTGGGGGCACAGCGGCCCTGGGCT
GCCTGGTCAAGGACTACTTCCCCGAACCGGTGACGGTGTCGTGGAACTCAGGCGCCCTGACC
AGCGGCGTGCACACCTTCCCGGCTGTCCTACAGTCCTCAGGACTCTACTCCCTCAGCAGCGT
GGTGACCGTGCCCTCCAGCAGCTTGGGCACCCAGACCTACATCTGCAACGTGAATCACAAGC
CCAGCAACACCAAGGTGGACAAGAAAGTTGAGCCCAAATCTTGTGACAAAACTCACACATG
TCCACCGTGCCCAGCACCTGAAGCAGCAGGGGGACCGTCAGTCTTCCTCTTCCCCCCAAAAC
CCAAGGACACCCTCATGATCTCCCGGACCCCTGAGGTCACATGCGTGGTGGTGAGCGTGAGC
CACGAAGACCCTGAGGTCAAGTTCAACTGGTACGTGGACGGCGTGGAGGTGCATAATGCCA
AGACAAAGCCGCGGGAGGAGCAGTACAACAGCACGTACCGTGTGGTCAGCGTCCTCACCGT
CCTGCACCAGGACTGGCTGAATGGCAAGGAGTACAAGTGCAAGGTCTCCAACAAAGCCCTC
CCAGCCCCCATCGAGAAAACCATCTCCAAAGCCAAAGGGCAGCCCCGAGAACCACAGGTGT
ACGTGTACCCCCCATCCCGGGAGGAGATGACCAAGAACCAGGTCAGCCTGACCTGCCTGGT
CAAAGGCTTCTATCCCAGCGACATCGCCGTGGAGTGGGAGAGCAATGGGCAGCCGGAGAAC
AACTACAAGACCACGCCTCCCGTGCTGGACTCCGACGGCTCCTTCGCCCTCGTGAGCAAGCT
CACCGTGGACAAGTCTAGATGGCAGCAGGGGAACGTCTTCTCATGCTCCGTGATGCATGAGG
CTCTGCACAACCACTACACGCAGAAGAGCCTCTCCCTGTCTCCGGGT >SEQ ID NO: 713 (CD3W245 Fab-Fc LC2 cDNA)
GACATACAAATGACACAATCACCCTCTTCTCTTTCTGCAAGCGTTGGCGACCGTGTCA
CTATCACTTGTCGAGCCCGCCAGTCCATAGGTACTGCCATTCACTGGTATCAACAGAAGCCT
GGCAAGGCTCCCAAACTCCTGATTAAGTATGCCAGCGAGAGCATTTCCGGCGTACCTTCAAG
ATTTTCCGGCTCCGGTAGTGGGACAGATTTCACTCTCACTATATCTAGCCTCCAACCAGAAG
ATTTCGCCACTTACTACTGTCAACAATCAGGTTCATGGCCTTACACTTTCGGCCAGGGGACA
AAATTGGAGATCAAGCGGACAGTGGCCGCTCCTTCCGTGTTCATCTTCCCACCTTCCGACGA
GCAGCTGAAGTCCGGCACAGCTTCTGTCGTGTGCCTGCTGAACAACTTCTACCCTCGGGAAG
CCAAGGTGCAGTGGAAGGTGGACAATGCCCTGCAGTCCGGCAACTCCCAAGAGTCTGTGAC
CGAGCAGGACTCCAAGGACAGCACCTACAGCCTGTCCTCCACACTGACCCTGTCCAAGGCCG
ACTACGAGAAGCACAAGGTGTACGCCTGCGAAGTGACCCATCAGGGCCTGTCTAGCCCTGT
GACCAAGTCTTTCAACCGGGGCGAGTGT >SEQ ID NO: 714 (CD3B376 Fab-Fc HC2 KIH cDNA)
CAGGTGCAGCTGCAGCAGTCTGGCCCTAGACTCGTGCGGCCTTCCCAGACCCTGTCT
CTGACCTGTGCCATCTCCGGCGACTCCGTGTTCAACAACAACGCCGCCTGGTCCTGGATCCG TABLE 77-continued

| HC and LC DNA SEQ ID NOs of DLL3/CD3 bispecific antibodies |
|---|
| GCAGTCTCCATCTCGCGGTCTGGAGTGGCTCGGTCGCACCTACTACCGCTCTAAATGGCTGT<br>ACGACTACGCCGTGTCCGTGAAGTCCCGGATCACCGTGAACCCTGACACCTCCCGGAACCAG<br>TTCACCCTGCAGCTGAACTCCGTGACCCCTGAGGACACCGCCCTGTACTACTGCGCCAGAGG<br>CTACTCCTCCTCCTTCGACTATTGGGGCCAAGGCACCCTCGTGACCGTGTCCTCTGCCTCCAC<br>CAAGGGCCCATCGGTCTTCCCCCTGGCACCCTCCTCCAAGAGCACCTCTGGGGGCACAGCGG<br>CCCTGGGCTGCCTGGTCAAGGACTACTTCCCCGAACCGGTGACGGTGTCGTGGAACTCAGGC<br>GCCCTGACCAGCGGCGTGCACACCTTCCCGGCTGTCCTACAGTCCTCAGGACTCTACTCCCTC<br>AGCAGCGTGGTGACCGTGCCCTCCAGCAGCTTGGGCACCCAGACCTACATCTGCAACGTGAA<br>TCACAAGCCCAGCAACACCAAGGTGGACAAGAAAGTTGAGCCCAAATCTTGTGACAAAACT<br>CACACATGCCCACCGTGCCCAGCACCTGAAGCCGCCGGGGGACCGTCAGTCTTCCTCTTCCC<br>CCCAAAACCCAAGGACACCCTCATGATCTCCCGGACCCCTGAGGTCACATGCGTGGTGGTGA<br>GCGTGAGCCACGAAGACCCTGAGGTCAAGTTCAACTGGTACGTGGACGGCGTGGAGGTGCA<br>TAATGCCAAGACAAAGCCGCGGGAGGAGCAGTACAACAGCACGTACCGTGTGGTCAGCGTC<br>CTCACCGTCCTGCACCAGGACTGGCTGAATGGCAAGGAGTACAAGTGCAAGGTGTCGAACA<br>AAGCCCTCCCAGCCCCCATCGAGAAAACCATCTCCAAAGCCAAAGGGCAGCCCCGAGAACC<br>ACAGGTGTACACCCTGCCCCCATCCCGGGAGGAGATGACCAAGAACCAGGTCAGCCTGTCC<br>TGCGCCGTCAAAGGCTTCTATCCCAGCGACATCGCCGTGGAGTGGGAGAGCAATGGGCAGC<br>CGGAGAACAACTACAAGACCACGCCTCCCGTGCTGGACTCCGACGGCTCCTTCTTCCTCGTG<br>AGCAAGCTCACCGTGGACAAGAGCAGATGGCAGCAGGGGAACGTCTTCTCATGCTCCGTGA<br>TGCATGAGGCTCTGCACAACCGGTTCACGCAGAAGTCTCTCTCCCTGTCTCCGGGAAAA |
| >SEQ ID NO: 715 (CD3B376 Fab-Fc LC KIH cDNA)<br>CAGTCTGCTCTGACCCAGCCTGCCTCCGTGTCTGGCTCTCCCGGCCAGTCCATCACCA<br>TCAGCTGTACCGGCACCTCCTCCAACATCGGCACCTACAAGTTCGTGTCCTGGTATCAGCAG<br>CACCCCGACAAGGCCCCCAAAGTGCTGCTGTACGAGGTGTCCAAGCGGCCCTCTGGCGTGTC<br>CTCCAGATTCTCCGGCTCCAAGTCTGGCAACACCGCCTCCCTGACCATCAGCGGACTGCAGG<br>CTGAGGACCAGGCCGACTACCACTGTGTGTCCTACGCTGGCTCTGGCACCCTGCTGTTTGGC<br>GGAGGCACCAAGCTGACCGTGCTGGGTCAGCCCAAGGCTGCACCCAGTGTCACTCTGTTCCC<br>GCCCTCCTCTGAGGAGCTTCAAGCCAACAAGGCCACACTGGTGTGTCTCATAAGTGACTTCT<br>ACCCGGGAGCCGTGACAGTGGCCTGGAAGGCCGATAGCAGCCCCGTCAAGGCGGGAGTGGA<br>GACCACCACACCCTCCAAACAAAGCAACAACAAGTACGCGGCCAGCAGCTATCTGAGCCTG<br>ACGCCTGAGCAGTGGAAGTCCCACAGAAGCTACAGCTGCCAGGTCACGCATGAAGGGAGCA<br>CCGTGGAGAAGACAGTGGCCCCTACAGAATGTTCA |

Example 19. Characterization of Bispecific DLL3×CD3 Antibodies

Effect of DLL3 Epitope on the Bispecific DLL3×CD3 Mediated Cytotoxicity

To determine the effect of DLL3 epitope on bispecific DLL3×CD3 mediated killing on $DLL^{3+}$ target cells, a T cell redirection was performed using human pan T cells as effectors and SHP-77 cells as targets at a 3:1 ratio for 72 hours. An equal volume (100 ul) of 2× test sample, in ½ log dilutions from 20 nM (final starting at 10 nM) was added to 50,000 CSFE-labelled SHP-77 cells mixed with 150,000 pan T cells in a final volume of 200 ul RPMI, 10% FBS for 72 hr at 37° C. After 72 hours, plates were washed 1× with PBS, incubated for 20 minutes with Near IR L/D stain and BV421-labeled anti-CD25 antibody in stain buffer. The cells were washed twice with stain buffer, resuspended in 25 ul Accutase for 10 minutes, and then 25 ul of QSol buffer was added. The plates were read on an IQue plus and cells were gated on CSFE positive populations (Tumor cells) and CSFE-negative cells (T cells) and both populations were subsequently gated on live/dead staining. Live T cells were further gated on CD25 staining. Outputs calculated were % Tumor killing, % CD25 T cell activation, and T cell viability. A ruby red stained control (mock 100% dead) and T cell only/SHP-77 only were used to gate nuclei containing cells from debris and then the individual cell populations. Data was analyzed in GeneData Screenr using 4 parameter curve fits. The tables below show the maximal percent lysis of SHP-77 cells observed at the end of 72 hours for each DLL3 binder paired with the various CD3 arms. The results indicate that the % tumor killing is dependent on the binding epitope on DLL3, the further it is from the membrane the lesser the cell lysis (Table 78-80). The % tumor killing was improved as the DLL3 binding epitopes became more membrane proximal. This trend is relatively consistent when the DLL3 binders were paired with 3 different CD3.

Inventors have unexpectedly discovered that an interesting trend appears where maximum killing in each domain increases as the binding domain within the DLL3 moves towards the C-terminus in the primary sequence or proximal to the tumor membrane. In particular, maximum killing efficiency improves from EGF2 to EGF6 and reaches the highest percentage, when the tested antibody binds at the EGF-6 domain or closer to the c-terminus.

TABLE 78

% lysis of SHP-77 on day 3 after coculture with human pan T-cells and bispecific anti- DLL3 × CD3W245 antibodies at 3:1 ET ratio (CD3:target cells).

| Name | Sample description | DLL3 Arm | Epitope | % Max. Killing |
|---|---|---|---|---|
| CD3B1706 | CD3W245-Fab-RF; DL3B279-scFv | DL3B279-scFv | EGF6 | 89.7 |
| CD3B1506 | CD3W245-Fab-RF; DL3B463-scFv | DL3B463-scFv | EGF3/EGF4 | 94.5 |

TABLE 78-continued

% lysis of SHP-77 on day 3 after coculture with human pan T-cells and bispecific anti- DLL3 × CD3W245 antibodies at 3:1 ET ratio (CD3:target cells).

| Name | Sample description | DLL3 Arm | Epitope | % Max. Killing |
|---|---|---|---|---|
| CD3B1346 | CD3W245-Fab-RF; DL3B419-scFv | DL3B419-scFv | EGF2/EGF3 | 85.2 |
| CD3B1586 | CD3W245-Fab-RF; DL3B470-scFv | DL3B470-scFv | DSL | 55.5 |

TABLE 79

% lysis of SHP-77 on day 3 after coculture with human pan T-cells and bispecific anti- DLL3 × CD3B376 antibodies at 3:1 ET ratio (CD3:target cells).

| Name | Sample description | DLL3 Arm | Epitope | % Max. Killing |
|---|---|---|---|---|
| CD3B1738 | CD3B376-Fab-RF; DL3B279-scFv | DL3B279-scFv | EGF6 | 74.3 |
| CD3B1538 | CD3B376-Fab-RF; DL3B463-scFv | DL3B463-scFv | EGF3/EGF4 | 25.9 |
| CD3B1378 | CD3B376-Fab-RF; DL3B419-scFv | DL3B419-scFv | EGF2/EGF3 | 49.1 |
| CD3B1618 | CD3B376-Fab-RF; DL3B470-scFv | DL3B470-scFv | DSL | 3.4 |

TABLE 80

% lysis of SHP-77 on day 3 after coculture with human pan T-cells and bispecific anti-DLL3 × CD3B219 antibodies at 3:1 ET ratio (CD3:target cells).

| Name | Sample description | DLL3 Arm | Epitope | % Max. Killing |
|---|---|---|---|---|
| CD3B1737 | CD3B219-Fab-RF; DL3B279-scFv | DL3B279-scFv | EGF6 | 86.4 |
| CD3B1377 | CD3B219-Fab-RF; DL3B419-scFv | DL3B419-scFv | EGF2/EGF3 | 73.1 |
| CD3B1617 | CD3B219-Fab-RF; DL3B470-scFv | DL3B470-scFv | DSL | 21.9 |

Binding Affinity of Bispecific Anti-DLL3×CD3 Antibodies to DLL3

The binding affinity of anti-DLL3×CD3 antibodies to the recombinant human DLL3 was determined by surface plasmon resonance (SPR) using a Biacore® T200 instrument. The antibodies were captured on a goat anti-Fc antibody-modified C1 chip and titrated with 3-fold serial dilutions of DLL3 antigen spanning concentrations of 90 nM to 1.1 nM. The association was monitored for 2 minutes and the dissociation for 5 or 60 minutes, using a flow rate of 100 μL/min. Raw binding data was referenced by subjecting the analyte binding signals from blanks and analyzed using a 1:1 Langmuir binding model using the Biacore® Insight evaluation software to obtain the kinetics which were used to calculate the binding affinity. Binding affinities of anti-DLL3×CD3 antibodies to the recombinant human DLL3 are summarized in Table 81.

TABLE 81

Affinities (KD) for the interaction of anti-DLL3 CD3 bispecific antibodies with human DLL3 as obtained by the Biacore (SPR) method. The antibodies were captured using an anti-human Fc antibody and the antigens were injected in solution.

| Name | Description | $k_D$ (pM) |
|---|---|---|
| DL3B582 | CD3W245-LH-scFv; DL3B279-Fab | 16 |
| DL3B583 | CD3W245-HL-scFv; DL3B279-Fab | 16 |
| DL3B585 | CD3B376-Fab; DL3B279-LH-scFv | 24 |
| DL3B587 | CD3W245-Fab; DL3B279-LH-scFv | 31 |

Thermal Stability of Bispecific Anti-DLL3×CD3 Antibodies

The thermal stability (conformational stability) bispecific anti-DLL3×CD3 antibodies was determined by NanoDSF method using an automated Prometheus instrument. Measurements were made by loading sample into 24 well capillary from a 384 well sample plate. Duplicate runs were performed. The thermal scans span from 20° C. to 95° C. at a rate of 1.0° C./minute. The data was proceed to obtain integrated data and first derivation analysis for 330 nm, 350 nm, Ratio 330/350, and scatter data from which thermal transitions, onset of unfolding, $T_m$ and $T_{agg}$ were obtained.

The results show that these bispecific anti-DLL3×CD3 antibodies have a first transition ($T_{m1}$) higher than 59° C. The results also show that most proteins, except DL3B585 have low aggregation potential with $T_{agg}$ above 70° C. and 5 degrees or more higher than $T_{m1}$ (Table 82).

TABLE 82

Thermal stability data for bispecific anti-DLL3 × CD3 antibodies as obtained using a NanoDSF instrument.

| Name | Description | $T_{agg}$ | $T_{m1}$ |
|---|---|---|---|
| DL3B582 | CD3W245-LH-scFv; DL3B279-Fab | 74.7° C. | 63.3° C. |
| DL3B583 | CD3W245-HL-scFv; DL3B279-Fab | 75.4° C. | 63.1° C. |
| DL3B585 | CD3B376-Fab; DL3B279-LH-scFv | 62.7° C. | 60.8° C. |
| DL3B587 | CD3W245-Fab; DL3B279-LH-scFv | 74.6° C. | 62.4° C. |

Binding of Bispecific Anti-DLL3×CD3 Antibodies on DLL3$^+$ Tumor Cells

We determined the cell binding profiles of the bispecific anti-DLL3×CD3 antibodies to DLL3$^+$ human tumor cell lines (HCC1833 and SHP-77). The adherent SCLC HCC1833 cells were washed with DPBS and 0.25% trypsin was added to allow cells to detach. The media was added to neutralize trypsin and the cells were transferred to a 15 mL conical tube. The suspension SCLC SHP77 cells were transferred to a 15 mL conical tube and were centrifuged 1200 rpm for 3 minutes. The media was aspirated and the cells were washed once more with DPBS. The cells were counted using the Vi-cell XR cell viability analyzer and were plated at 100K/well in 100 uL DPBS. The plate was centrifuged $1^{200}$ rpm for 3 minutes and washed 2× with DPBS. The cells were stained with Violet Live/Dead stain (Thermo-Fisher) and incubated at RT in the dark for 25 min. The cells were centrifuged and washed 2× with FACS staining buffer (BD Pharmingen).

The test antibodies were diluted to a final starting concentration of 100 nM in FACS staining buffer and 3-fold serial dilutions were prepared from the starting concentration for a total of 10 dilution points. The serially diluted test antibodies (100 uL/well) were added to the cells and incubated for 30 min at 37° C. The cells were washed 2× with FACS staining buffer and AlexaFluor® 647-conjugated Donkey anti-human secondary antibody (Jackson Immunoresearch) was added and allowed to incubate with the cells for 30 min at 4° C. Then the cells were washed 2× with FACS staining buffer and re-suspended in 100 uL FACS Buffer. The cells were run on BD Celesta using FACS Diva software and analyzed using FlowJo software. As shown in FIGS. 26A and 26B, the binding profiles between the DLL3-Fab arms (DL3B582 and DL3B583) and DLL3-scFv arms (DL3B585 and DL3B587) are moderately different.

Binding of Bispecific Anti-DLL3×CD3 Antibodies on Pan T-Cells

The cell binding profiles of the bispecific anti-DLL3×CD3 antibodies to normal human T cells were also evaluated. Human Pan T Cells (Biological Specialty Corporation, Colmar, PA) were thawed and transferred to a 15 mL conical with DPBS (Dulbecco's Phosphate Saline Buffer). The cells were centrifuged 1300 rpm for 5 minutes. DPBS was aspirated and the cells were re-suspended in DPBS. The cells were counted using the Vi-cell XR cell viability analyzer and were plated at 100K/well in 100 uL DPBS. The plate was centrifuged 1200 rpm for 3 minutes and washed 2× with DPBS. The cells were stained with Violet Live/Dead stain (Thermo-Fisher) and incubated at RT in the dark for 25 min. The cells were centrifuged and washed 2× with FACS staining buffer (BD Pharmigen). Test antibodies were diluted to a final starting concentration of 100 nM in FACS staining buffer and 3-fold serial dilutions were prepared from the starting concentration for a total of 10 dilution points. The serially diluted test antibodies (100 uL/well) were added to the cells and incubated for 30 min at 37° C. Cells were washed 2× with FACS staining buffer and AlexaFluor® 647-conjugated Donkey anti-human secondary antibody (Jackson Immunoresearch) was added and allowed to incubate with the cells for 30 min at 4° C. Cells were washed 2× with FACS staining buffer and re-suspended in 100 uL FACS Buffer. Cells were run on BD Celesta using FACS Diva software and analyzed using FlowJo software. As shown in FIG. 27, the cell binding profiles are different across the various CD3 arms.

Bispecific DLL3×CD3 Mediated Cytotoxicity Against DLL3$^+$ Target Cell Lines in Pan T-Cells We evaluated the T-cell mediated killing potential of the bispecific anti-DLL3×CD3 antibodies in DLL3$^+$ and DLL3$^+$ cell lines. DLL3$^+$ SHP77 and DLL3-HEK293 stably expressing red nuclear dye were generated to be used in the IncuCyte-based cytotoxicity assay. Frozen vials of healthy donor T-cells (Biological Specialty Corporation, Colmar, PA) were thawed in a 37° C. water bath, transferred to a 15 mL conical tube, and washed once with 5 mL phenol-red-free RPMI/10% HI FBS medium. The cells were counted using the Viacell XR cell viability analyzer and the T-cells were combined with target cells for a final effector T-cell to target cell (E: T) ratio of 5:1. The cell mixture (100 uL/well) was combined in a 50 mL conical tube and added to a clear 96-well flat-bottom plate. The test antibodies were then diluted to a final starting concentration of 60 nM in phenol-red-free RPMI/10% HI FBS medium and 3-fold serial dilutions were prepared from the starting concentration for a total of 11 dilution points. The serially diluted test antibodies (100 uL/well) were added to the combined cells. The plates were placed in either an IncuCyte® Zoom or an IncuCyte S3® (Essen) at 37° C. with 5% $CO_2$ for 120 hours. The target cell lines stably express red nuclear dye which was used to track the kinetics of target cell lysis. Percent cell growth inhibition (%)=(Initial viable target cell number—Current viable target cell number)/Initial viable cell number*100%. As shown in FIGS. 28A and 28B, the T cell cytotoxicity assay results demonstrate that all bispecific anti-DLL3×CD3 antibodies are capable of achieving >95% tumor lysis by 5 days.

Cytokine Induction Mediated by Bispecific DLL3×CD3 Antibodies in Pan T-Cells

We evaluated the cytokine release profiles of the bispecific anti-DLL3×CD3 antibodies in a DLL3$^+$ human tumor cell line. The supernatants were analyzed using the Human Proinflammatory Panel I tissue culture kit (Meso Scale Discovery) and were thawed on wet ice, spun at 1,500 rpm for 5 minutes at 4° C., then placed on ice. The MULT-SPOT assay plates were pre-washed per the manufacturer's protocol. A standard curve was prepared by serial dilution of the provided calibrators in MSD Diluent 1. The standards and test antibody samples (25 uL/well) were added to the pre-washed plates. Assay plates were read on the SECTOR Imager 6000. As shown in FIG. 29, the results of the cytokine profiling experiment demonstrate that IFN-gamma production correlates with the CD3 affinity of the bispecific anti-DLL3×CD3 antibodies.

83. % lysis was calculated as ={100−(red signal intensity at a specific time point with Antibody/red signal intensity at that time point in NBS wells)*100}.

TABLE 83

% lysis of SHP-77, HCC1833 and G361 cells on day 5 after coculture with whole PBMCs and bispecific anti-DLL3 × CD3 antibodies at the indicated concentrations using a 1:1 ET ratio (CD3:target cells). NA indicates not tested.

| Molecules | | Cytotoxicity (% Lysis at Day 6, 1:1 ET ratio) | | |
|---|---|---|---|---|
| | | SHP-77 | G361 | HCC1833 |
| Name | Description | 30 nM | 30 nM | 30 nM |
| DL3B582 | CD3W245-LH-scFv DL3B279-Fab | 87.3 | 98.9 | 93.7 |
| DL3B583 | CD3W245-HL-scFv DL3B279-Fab | 99.8 | 98.9 | 88.4 |
| DL3B585 | CD3B376-Fab DL3B279-LH-scFv | 58.1 | NA | NA |
| DL3B587 | CD3W245-Fab DL3B279-LH-ScFv | 83.3 | NA | NA |

Bispecific DLL3×CD3 Mediated Cytotoxicity Against DLL3$^+$ Target Cell Lines in PBMCs In order to test the efficacy of the bispecifics against DLL3$^+$ target cells with varying levels of antigen expression, DLL3 high expression (SHP-77 and HCC1833) and DLL3 low expression cell line (G361) were tested in the cytotoxicity assay. SHP-77 and HCC1833 are lung epithelial and lung adenocarcinoma cell lines, respectively. G361 cells are derived from malignant skin melanoma. DLL3$^+$ SHP-77 cell line stably expressing the nuclear restricted NucLight Red (NLR) protein was used in the cytotoxicity assay. On the day of the assay, SHP-77-NLR cells were collected into a 50 ml falcon tube and spun down at 1300 rpm for 5 min. The cell pellet was then resuspended in modified RPMI 1640 media+10% FBS (complete media) and cell count was estimated using trypan blue live dead marker using a hemocytometer. SHP-77-NLR cells were then plated onto a collagen coated 96 well plate at 10,000 cells/well/90 µl of complete media. The cells were evenly distributed by gentle agitation and allowed to settle for 1 hour in a 5% $CO_2$ incubator. In the case of HCC1833 and G361 target cell lines, 3000 cells/well/90 µl complete media were plated in a 96 well flat bottom tissue culture plates one day prior to the PBMC addition.

The vials of PBMCs frozen from healthy donors (Clinigene) were rapidly thawed in a 37° C. water bath, transferred to a 15 mL conical tube, and washed once with 10 mL complete medium. The cells were stained with anti-human CD3 antibody and analyzed by flow cytometer to determine the CD3% within PBMCs. PBMCs from each donor were counted using trypan blue live dead marker using a hemocytometer and the number of PBMCs required to get required effector to target (ET) ratios (CD3: target cell) were added to the plated target cells in 90 µl complete media. The test antibodies were then prepared as 10× stocks in complete media and 3-fold serial dilutions were prepared. The serially diluted test antibodies were added to the PBMC-tumor coculture at 20 µl/well so that the final concentration of antibody became 1×. Wells with no antibody (NBS) were used as control for the basal cytotoxicity. The plates were placed in an IncuCyte S3® (Essen BioScience) at 37° C. with 5% $CO_2$ for 5 days. Increase in red signal corresponds to target cell proliferation and a decrease in signal corresponds to target cell death. Results are summarized in Table 83. % lysis was calculated as ={100−(red signal intensity at a specific time point with Antibody/red signal intensity at that time point in NBS wells)*100}.

Potent tumor cell lysis was observed with bispecifics DLL3×CD3 antibodies across cell lines of different origin and antigen densities. To compare the efficacy of the high affinity CD3 bispecific (DL3B583) with the low affinity CD3 bispecific (DL3B585), the cytotoxicity against DLL3 high expression SHP-77 cells was tested at various ET ratios. The whole PBMCs from 3 donors were cultured with DLL3$^+$ SHP-77-NLR cells at the indicated ET ratios (CD3: SHP-77) in the presence of the bispecific DLL3×CD3 antibodies. Wells with PBMCs and target cells but no antibody were used as control for basal cytotoxicity. Plates were scanned for up to 120 hours in an IncuCyte S3® (Essen BioScience) in a 37° C. with 5% CO2 incubator. % lysis was calculated as ={100−(red signal intensity at a specific time point with Antibody/red signal intensity at that time point in NBS wells)*100}. Each point on the graph represents an average of 3 donors. As shown in FIGS. 30A-30C, bispecific DLL3×CD3 antibodies with both the high affinity CD3 (DL3B583) and low affinity CD3 (DL3B585) arms showed robust cytotoxicity against SHP-77 cells. Target cell lysis at 90 nM and 30 nM antibody concentration was similar between the high and low affinity CD3 antibody for 10:1 ET ratio.

Proliferation of CD3$^+$ T Cells in Response to Bispecific DLL3×CD3 Antibodies in Whole PBMC Cytotoxicity Assay In order to test if the binding of bispecific DLL3×CD3 antibodies to CD8$^+$ T cells can induce proliferation and expansion of CD8$^+$ T cells, the time course analysis of CD8$^+$ T cell proliferation was performed. DLL3$^+$ SHP-77 cells were used for the assay. On the day of the assay, SHP-77 cells were collected into a 50 ml falcon tube and spun down at 1300 rpm for 5 min. The cell pellet was then resuspended in 1 ml modified RPMI 1640 media+10% FBS (complete media) and cell count was estimated using trypan blue live dead marker using a hemocytometer. SHP77 cells were then plated in a U-bottom 96 well plate at 10,000 cells/well/90 µl of complete media.

The vials of PBMCs frozen from healthy donors (Clinigene) were rapidly thawed in a 37° C. water bath, transferred to a 15 mL conical tube, and washed once with 10 mL complete medium. The cells were stained with anti-human CD3 antibody and analyzed by flow cytometer to determine the CD3% within PBMCs. PBMCs were stained Cell Trace Violet dye (C34571, Thermo Fisher Scientific). PBMCs from each donor were counted using trypan blue live dead marker using a hemocytometer and the number of PBMCs required to get effector to target (ET) ratio of 10:1 (CD3: target cell) were added to the plated target cells in 90 μl complete media.

The test antibodies were then prepared as 10× stocks in complete media and 3-fold serial dilutions were prepared from the starting concentration for a total of 3 dilution points. The serially diluted test antibodies were added to the PBMC-tumor coculture at 20 μl/well so that the final concentration of antibody became 1×. Wells with no antibody (NBS) were used as control for the basal cytotoxicity. The plates were incubated in a 5% $CO_2$ incubator for the indicated time periods. At the end of the incubation period, the cells suspension was transferred to a v-bottom plate and was spun down at 1500 rpm for 5 min. The pellet was resuspended in 100p of DPBS. 10p of the cell suspension was taken for determining the total cell count at each antibody concentration using Trypan blue with a hemocytometer. The rest of the cell suspension was subjected to LIVE/DEAD™ Fixable Near-IR Dead Cell Stain Kit (L10119) and incubated for 20 min on ice. The viability stain was inactivated using FACS buffer and was spun down at 1500 rpm for 5 min. Cells were stained with BD Fc block (564220, BD Pharmingen) for 10 min followed by staining with CD3 and CD8 antibodies and acquired on a flow cytometer. Gating on CD8 T cells was performed to estimate the expansion of the cytotoxic CD8 T cell population within the CD3 T cells. As shown in FIG. 31, binding of the bispecific DLL3×CD3 antibodies to T cells potently mediates the expansion of cytotoxic CD8 T cells.

Activation Profile of CD8 T Cells by Bispecific DLL3×CD3 Antibodies in Whole PBMC Assay In order to look at the activation status of the cytotoxic CD8 T cell population in response to the binding of the DLL3×CD3 bispecifics, kinetic analysis of CD25, CD69 and CD71 markers was performed. $DLL3^+$ SHP-77 cells were used for the assay. SHP-77 cells were collected into a 50 ml falcon tube and spun down at 1300 rpm for 5 min. The cell pellet was then resuspended in 1 ml modified RPMI 1640 media+10% FBS (complete media) and cell count was estimated using trypan blue live dead marker using a hemocytometer. SHP-77 cells were then plated in a U-bottom 96 well plate at 10,000 cells/well/90 μl of complete media.

Vials of PBMCs frozen from healthy donors (Clinigene) were rapidly thawed in a 37° C. water bath, transferred to a 15 mL conical tube, and washed once with 10 mL complete medium. The cells were stained with anti-human CD3 antibody and analyzed by flow cytometer to determine the CD3% within PBMCs. PBMCs from each donor were counted using trypan blue live dead marker using a hemocytometer and the number of PBMCs required to get effector to target (ET) ratio of 10:1 (CD3: target cell) were added to the plated target cells in 90 μl complete media.

The test antibodies were prepared as 10× stocks in complete media and 3-fold serial dilutions were prepared from the starting concentration for a total of 3 dilution points. The serially diluted test antibodies were added to the PBMC-tumor coculture at 20 μl/well so that the final concentration of antibody became 1×. Wells with no antibody (NBS) were used as control for the basal cytotoxicity. The plates were incubated in a 5% CO2 incubator for the indicated time periods. At the end of the incubation period the cells suspension was transferred to a v-bottom plate and was spun down at 1500 rpm for 5 min. The pellet was resuspended in 100 μl of DPBS. 10 μl of the cell suspension was taken for determining the total cell count at each antibody concentration using Trypan blue with a hemocytometer.

The rest of the cell suspension was subjected to LIVE/DEAD™ Fixable Near-IR Dead Cell Stain Kit (L10119) and incubated for 20 min on ice. The viability stain was inactivated using FACS buffer and was spun down at 1500 rpm for 5 min. The cells were stained with BD Fc block (564220, BD Pharmingen) for 10 min followed by staining with CD3, CD8, CD25, CD69 and CD71 antibodies and acquired on a flow cytometer. As shown in FIGS. 32A-32C, potent activation of cytotoxic CD8 T cells was seen with the bispecific DLL3×CD3 antibodies as indicated by the upregulation of CD25, CD69 and CD71 expression on the surface of CD8 T cells.

Cytokine Induction Mediated by Bispecific DLL3×CD3 Antibodies in Whole PBMC Assay T cell redirecting bispecific antibodies can cause toxicity because of the induction of cytokine release syndrome. These cytokines can be produced by T cell themselves or myeloid cells and results in a feedback loop of more cytokine production. In order to understand the release of cytokines such as IL-6, TNF-a, IL-10, GMCSF and other T cell cytokines by the addition of DLL3×CD3 bispecifics, culture supernatants from cytotoxicity assays were tested for the levels of these cytokines. $DLL3^+$ SHP-77 cells were used for the assay. SHP-77 cells were collected into a 50 ml falcon tube and spun down at 1300 rpm for 5 min. The cell pellet was then resuspended in 1 ml modified RPMI 1640 media+10% FBS (complete media) and the cell count was estimated using trypan blue live dead marker using a hemocytometer. SHP-77 cells were then plated in a U-bottom 96 well plate at 10,000 cells/well/90 μl of complete media.

The vials of PBMCs frozen from healthy donors (Clinigene) were rapidly thawed in a 37° C. water bath, transferred to a 15 mL conical tube, and washed once with 10 mL complete medium. The cells were stained with anti-human CD3 antibody and analyzed by flow cytometer to determine the CD3% within PBMCs. PBMCs from each donor were counted using trypan blue live dead marker using a hemocytometer and the number of PBMCs required to get effector to target (ET) ratio of 10:1 (CD3: target cell) were added to the plated target cells in 90 μl complete media.

The test antibodies were prepared as 10× stocks in complete media and added to the PBMC-tumor coculture at 20 μl/well so that the final concentration of antibody became 1×. Wells with no antibody (NBS) were used as control for the basal cytotoxicity. The plates were incubated in a 5% CO2 incubator for the indicated time periods. At the end of the incubation period the cells suspension was transferred to a v-bottom plate and was spun down at 1500 rpm for 5 min. The supernatant was collected and stored at −20° C. to perform Luminex using the MILLIPLEX MAP Human $CD8^+$ T Cell Magnetic Bead Panel (HCD8MAG-15K, Millipore). Plate was analyzed using MAGPIX with eXPONENT software. Results are summarized in Table 84.

TABLE 84

Cytokine release mediated by bispecific DLL3 × CD3 antibodies in whole PBMC cytotoxicity assay: Whole PBMCs from 3 donors were cultured with DLL3+ SHP-77 cells at a 10:1 ET ratio (CD3: SHP-77) in the presence of the CD3 × DLL3 antibodies at 30 nM concentration for DL3B582 and DL3B583 and 90 nM for DL3B585. Supernatant was collected at indicated time points and analyzed for cytokine release using Luminex. Each point on the graph is an average of 3 donors.

| | Bispecific DLL3 × CD3 antibodies | | |
|---|---|---|---|
| Cytokines (ng/ml) | DL3B582 | DL3B584 | DL3B585 |
| TNFα | 2.7 | 2.0 | 1.1 |
| GMCSF | 0.8 | 1.0 | 0.5 |
| IL-10 | 13.5 | 20.7 | 1.9 |
| IL-13 | 0.5 | 0.4 | 0.5 |
| Gzm B | 9.7 | 9.6 | 1.0 |
| IL-2 | 1.0 | 0.8 | 0.0 |
| IL-4 | 0.2 | 0.2 | 0.0 |
| IL-5 | 0.1 | 0.1 | 0.1 |
| IL-6 | 4.2 | 4.8 | 0.9 |

Low levels of cytokine release was observed with the bispecific DLL3×CD3 antibody with lower affinity CD3 (DL3B585) as compared to the ones with higher affinity CD3 arms (DL3B582 and DL3B583), in particular, IL-10, IL-6, IL-2 and IL-4, while the cytotoxic potency of these bispecific DLL3×CD3 was comparable.

Example 20. Characterization of Bispecific Anti-DLL3×CD3 Antibody with Optimized Anti-DLL3 Antibody Sequence

Binding Affinity of Bispecific Anti-DLL3 Variant×CD3 Antibody to DLL3

In order to ensure the N to Q mutation in the HCDR1 region (or near the HCDR1 region depending on the delineation used) of the DL3B279 variant, as described in Example 1, did not result in change in binding to DLL3, the binding affinity of the DL3B279 variant to the recombinant human DLL3 was determined by surface plasmon resonance (SPR) using a Biacore® T200 instrument and compared to the parental DL3B279. The antibody was captured on a goat anti-Fc antibody-modified C1 chip and titrated with 3-fold serial dilutions of human and cyno DLLL3 antigen spanning concentrations from 90 nM to 1.1 nM. The association was monitored for 3 minutes and the dissociation for 60 minutes, using a flow rate of 50 uL/min. Raw binding data was referenced by subtracting the analyte binding signals from blanks and analyzed using a 1:1 Langmuir binding model using the Biacore® Insight evaluation software to obtain the kinetics which were used to calculate the binding affinity. The results (Table 85) showed that the binding affinity of the DLL3×CD3 bispecific (C3C3B80) containing the DL3B279 variant (DL3B279-VL-A99G-VH-N27Q_M105T-LH-scFv) is comparable to that of the original DLL3×CD3 bispecific (DL3B585) containing the original DL3B279-LH-scFV molecule (DL3B585: 24 PM).

TABLE 85

Affinities (KD) for the interaction of bispecific anti-DLL3 × CD3 antibody with human DLL3 as obtained by the Biacore (SPR) method. The anti-DLL3 antibodies were captured using an anti-human Fc antibody and the antigens were injected in solution

| Name | Description | $k_D$ (pM) |
|---|---|---|
| DL3B585 | HC1: CD3B376-Fab; HC2: DL3B279-LH-scFv | 24 |
| D3C3B80 | HC1: CD3B376-Fab × HC2: DL3B279-VL-A99G-VH-N27Q_M105T-LH-scFV | 33 |

Conformational Stability of Bispecific Anti-DLL3 Variant× CD3 Antibody by DSF The thermal stability (conformational stability) of bispecific anti-DLL3 CD3 antibody containing the new DL3B279 sequence of the DL3B279 variant (D3C3B80) was determined by NanoDSF method using an automated Prometheus instrument. Measurements were made by loading sample into 24 well capillary from a 384 well sample plate. Duplicate runs were performed. The thermal scans span from 20° C. to 95° C. at a rate of 1.0° C./minute. The data was processed to obtain integrated data and first derivation analysis for 330 nm, 350 nm, Ratio 330/350, and scatter data from which thermal transitions, onset of unfolding, $T_m1$ and $T_{agg}$ were obtained. The results (Table 86) showed that the thermostability of the bispecific DLL3×CD3 antibody with DL3B279-VL-A99G-VH-N27Q_M105T-LH-scFV variant (D3C3B80) is comparable to that in the original bispecific molecule with the original DL3B279-LH-scFv sequence (DL3B585: $T_{agg}$=62.7, $T_m1$=60.8 shown in Table 86).

TABLE 86

Thermal stability data for bispecific anti-DLL3 antibodies as obtained using a nanoDSF instrument.

| Name | Description | $T_{agg}$ | $T_{m1}$ |
|---|---|---|---|
| DL3B585 | HC1: CD3B376-Fab; HC2: DL3B279-LH-scFv | 62.7° C. | 60.8° C. |
| D3C3B80 | HC1: CD3B376-Fab × HC2: DL3B279-VL-A99G-VH N27Q_M105T-LH-scFV | 62.4° C. | 60.9° C. |

Binding of Bispecific Anti-DLL3 Variant×CD3 Antibody on T-Cells

Human Pan T Cells (Biological Specialty Corporation, Colmar, PA) were thawed and transferred to a 15 ml conical with DPBS. The cells were centrifuged 1300 rpm for 5 minutes. DPBS was aspirated and the cells were re-suspended in DPBS. The cells were counted using the Vi-cell XR cell viability analyzer and were plated at 100K/well in 100 uL DPBS. The plate was centrifuged 1200 rpm for 3 minutes and washed 2× with DPBS. Cells were stained with Violet Live/Dead stain (Thermo-Fisher) and incubated at RT in the dark for 25 min. The cells were centrifuged and washed 2× with FACS staining buffer (BD Pharmigen). Test antibodies were diluted to a final starting concentration of 100 nM in FACS staining buffer and 3-fold serial dilutions were prepared from the starting concentration for a total of 10 dilution points. The serially diluted test antibodies (100 uL/well) were added to the cells and incubated for 30 min at 37° C. Cells were washed 2× with FACS staining buffer and AlexaFluor® 647-conjugated Donkey anti-human secondary antibody (Jackson Immunoresearch) was added and allowed to incubate with the cells for 30 min at 4° C. Cells were washed 2× with FACS staining buffer and re-suspended in 100 uL FACS Buffer. Cells were run on BD Celesta using FACS Diva software and analyzed using FlowJo software. As shown in FIG. 33, the bispecific DLL3×CD3 antibody with DL3B279-VL-A99G-VH-N27Q_M105T-LH-scFv variant (D3C3B80) has comparable binding on T-cells as the original bispecific molecule with the original DL3B279-LH-scFv sequence (DL3B585).

Bispecific Anti-DLL3 Variant×CD3 Mediated Cytotoxicity Against DLL3+ Target Cell Lines in Pan T-Cells by IncuCyte DLL3+ SHP77 stably expressing red nuclear dye were generated to be used in the IncuCyte-based cytotoxicity assay. Frozen vials of healthy donor T-cells (Biological Specialty Corporation, Colmar, PA) were thawed in a 37° C. water bath, transferred to a 15 mL conical tube, and washed once with 5 mL phenol-red-free RPMI/10% HI FBS medium. The cells were counted using the Viacell XR cell viability analyzer and the T-cells were combined with target cells for a final effector T-cell to target cell (E: T) ratio of 5:1. The cell mixture was combined in a 50 mL conical tube. The cell mixture (100 uL/well) was added to a clear 96-well flat-bottom plate. Next, the test antibodies were diluted to a final starting concentration of 60 nM in phenol-red-free RPMI/10% HI FBS medium and 3-fold serial dilutions were prepared from the starting concentration for a total of 11 dilution points. The serially diluted test antibodies (100 uL/well) were added to the combined cells. The plates were placed in either an IncuCyte® Zoom or an IncuCyte S3® (Essen) at 37° C. with 5% CO2 for 120 hours. The target cell lines stably express red nuclear dye which is used to track the kinetics of target cell lysis. Percent cell growth inhibition is equal to the difference between the initial variable target cell number and the current viable target cell number divided by the initial viable cell number. As shown in FIG. 33B, the bispecific DLL3×CD3 antibody with DL3B279-VL-A99G-VH-N27Q_M105T-LH-scFV variant (D3C3B80) has comparable cell growth inhibition as the original bispecific molecule with the original DL3B279-LH-scFv sequence (DL3B585).

The present examples demonstrate that the isolated multispecific proteins disclosed herein are particularly effective at mediating T cell mediated cytotoxicity, promoting T cell activation and proliferation, increasing T cell cytokine release and/or displaying increased anti-tumor efficacy. These activities are a reflection of the combination of antigen binding domains targeting DLL3 on the target cell and CD3 on the T cell. The skilled person would understand that such activity would be expected from assembling the binding domains into a bispecific antibody, irrespective of the mechanism by which the bispecific antibody is assembled.

SEQUENCE LISTING (754 sequences)

SEQ ID NO: 1 - protein, 207 aa, Homo sapiens
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 2 - protein, 104 aa, Homo sapiens
DGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMD

SEQ ID NO: 3 - protein, 432 aa, Artificial Sequence
  Description of Artificial Sequence: Synthetic polypeptide
FKIPIEELEDRVFVNCNTSITWVEGTVGTLLSDITRLDLGKRILDPRGIYRCNGTDIYKDKESTVQVHYRMGSADDAKKDAAKKDDAKKDDAKKDGSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGLNDIFEAQKIEWHE

SEQ ID NO: 4 - protein, 426 aa, Artificial Sequence
  Description of Artificial Sequence: Synthetic polypeptide
QDGNEEMGGITQTPYKVSISGTTVILTCPQYPGSEILWQHNDKNIGGDEDDKNIGSDEDHLSLKEFSELEQSGYYVCYPRGSKPEDANFYLYLRARVGSADDAKKDAAKKDDAKKDDAKKDGSQSIKGNHLVKVYDYQEDGSVLLTCDAEAKNITWFKDGKMIGFLTEDKKKWNLGSNAKDPRGMYQCKGSQNKSKPLQVYYRMGSGSLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTFPPSQEEMTKNQVSLRCLVKGFYPSDIAVEWESNGQPENNYKTTKPVLDSDGSFRLESRLTVDKSRWQEGNVFSCSVMHEALHNHYTQKSLSLSGGHHHHHH

SEQ ID NO: 5 - protein, 805 aa, Artificial Sequence
  Description of Artificial Sequence: Synthetic polypeptide
QDGNEEMGGITQTPYKVSISGTTVILTCPQYPGSEILWQHNDKNIGGDEDDKNIGSDEDHLSLKEFSELEQSGYYVCYPRGSKPEDANFYLYLRARVGSADDAKKDAAKKDDAKKDDAKKDGSQSIKGNHLVKVYDYQEDGSVLLTCDAEAKNITWFKDGKMIGFLTEDKKKWNLGSNAKDPRGMYQCKGSQNKSKPLQVYYRMGGGSDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGSHHHHHHHH

SEQ ID NO: 6 - protein, 5 aa, Artificial Sequence
  Description of Artificial Sequence: Synthetic peptide
RYNMN

SEQ ID NO: 7 - protein, 17 aa, Artificial Sequence
  Description of Artificial Sequence: Synthetic peptide
SISTSSNYIYYADSVKG

SEQ ID NO: 8 - protein, 7 aa, Artificial Sequence
  Description of Artificial Sequence: Synthetic peptide
GWGPFDY

SEQ ID NO: 9 - protein, 11 aa, Artificial Sequence
  Description of Artificial Sequence: Synthetic peptide
RARQSIGTAIH

SEQ ID NO: 10 - protein, 7 aa, Artificial Sequence
  Description of Artificial Sequence: Synthetic peptide
YASESIS

SEQ ID NO: 11 - protein, 9 aa, Artificial Sequence
  Description of Artificial Sequence: Synthetic peptide
QQSGSWPYT

SEQ ID NO: 12 - protein, 7 aa, Artificial Sequence
  Description of Artificial Sequence: Synthetic peptide
GFTFSRY

SEQ ID NO: 13 - protein, 6 aa, Artificial Sequence
  Description of Artificial Sequence: Synthetic peptide
STSSNY

SEQ ID NO: 14 - protein, 6 aa, Artificial Sequence
  Description of Artificial Sequence: Synthetic peptide
GWGPFD

SEQ ID NO: 15 - protein, 7 aa, Artificial Sequence
  Description of Artificial Sequence: Synthetic peptide
RQSIGTA

SEQ ID NO: 16 - protein, 3 aa, Artificial Sequence
  Description of Artificial Sequence: Synthetic peptide
YAS

SEQ ID NO: 17 - protein, 6 aa, Artificial Sequence
  Description of Artificial Sequence: Synthetic peptide
SGSWPY

SEQ ID NO: 18 - protein, 8 aa, Artificial Sequence
  Description of Artificial Sequence: Synthetic peptide
GFTFSRYN

SEQ ID NO: 19 - protein, 8 aa, Artificial Sequence
  Description of Artificial Sequence: Synthetic peptide
ISTSSNYI

SEQ ID NO: 20 - protein, 9 aa, Artificial Sequence
  Description of Artificial Sequence: Synthetic peptide
TRGWGPFDY

SEQ ID NO: 21 - protein, 6 aa, Artificial Sequence
  Description of Artificial Sequence: Synthetic peptide
QSIGTA

SEQ ID NO: 22 - protein, 9 aa, Artificial Sequence
  Description of Artificial Sequence: Synthetic peptide
QQSGSWPYT

SEQ ID NO: 23 - protein, 116 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS

SEQ ID NO: 24 - protein, 107 aa, Artificial Sequence
  Description of Artificial Sequence: Synthetic polypeptide
DIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIK

SEQ ID NO: 25 - protein, 446 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26 - protein, 214 aa, Artificial Sequence
  Description of Artificial Sequence: Synthetic polypeptide
DILLTQSPGILSVSPGERVSFSCRARQSIGTAIHWYQQRTNGSPRLLIKYASESISGIPSRFSGSGSGTDFTLTINSVESEDIADYYCQQSNSWPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27 - protein, 107 aa, Artificial Sequence
  Description of Artificial Sequence: Synthetic polypeptide
DIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIK

SEQ ID NO: 28 - protein, 107 aa, Artificial Sequence
  Description of Artificial Sequence: Synthetic polypeptide
DIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIK

SEQ ID NO: 29 - protein, 107 aa, Artificial Sequence
  Description of Artificial Sequence: Synthetic polypeptide
DIQMTQSPSSLSASVGDRVTITCRARQSIGTAIHWYQQKPGKAPKLLIYYASESISGVPSRFSGSGSGTDFTLTISSLQPEDFATYYCQQSGSWPYTFGQGTKLEIK

SEQ ID NO: 30 - protein, 107 aa, Artificial Sequence
  Description of Artificial Sequence: Synthetic polypeptide
DILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIK

SEQ ID NO: 31 - protein, 20 aa, Artificial Sequence
  Description of Artificial Sequence: Synthetic peptide
GGSEGKSSGSGSESKSTGGS

SEQ ID NO: 32 - protein, 8 aa, Artificial Sequence
  Description of Artificial Sequence: Synthetic peptide
GGGSGGGS

SEQ ID NO: 33 - protein, 12 aa, Artificial Sequence
  Description of Artificial Sequence: Synthetic peptide
GGGSGGGSGGGS

SEQ ID NO: 34 - protein, 16 aa, Artificial Sequence
  Description of Artificial Sequence: Synthetic peptide
GGGSGGGSGGGSGGGS

SEQ ID NO: 35 - protein, 20 aa, Artificial Sequence
  Description of Artificial Sequence: Synthetic peptide
GGGSGGGSGGGSGGGSGGGS

SEQ ID NO: 36 - protein, 15 aa, Artificial Sequence
  Description of Artificial Sequence: Synthetic peptide
GGGGSGGGGSGGGGS

SEQ ID NO: 37 - protein, 20 aa, Artificial Sequence
  Description of Artificial Sequence: Synthetic peptide
GGGGSGGGGSGGGGSGGGGS

SEQ ID NO: 38 - protein, 25 aa, Artificial Sequence
  Description of Artificial Sequence: Synthetic peptide
GGGGSGGGGSGGGGSGGGGSGGGGS

SEQ ID NO: 39 - protein, 18 aa, Artificial Sequence
  Description of Artificial Sequence: Synthetic peptide
GSTSGSGKPGSGEGSTKG

SEQ ID NO: 40 - protein, 14 aa, Artificial Sequence
  Description of Artificial Sequence: Synthetic peptide
IRPRAIGGSKPRVA

SEQ ID NO: 41 - protein, 15 aa, Artificial Sequence
  Description of Artificial Sequence: Synthetic peptide
GKGGSGKGGSGKGGS

SEQ ID NO: 42 - protein, 15 aa, Artificial Sequence
  Description of Artificial Sequence: Synthetic peptide
GGKGSGGKGSGGKGS

SEQ ID NO: 43 - protein, 15 aa, Artificial Sequence
  Description of Artificial Sequence: Synthetic peptide
GGGKSGGGKSGGGKS

SEQ ID NO: 44 - protein, 15 aa, Artificial Sequence
  Description of Artificial Sequence: Synthetic peptide
GKGKSGKGKSGKGKS

SEQ ID NO: 45 - protein, 15 aa, Artificial Sequence
  Description of Artificial Sequence: Synthetic peptide
GGGKSGGKGSGKGGS

SEQ ID NO: 46 - protein, 15 aa, Artificial Sequence
  Description of Artificial Sequence: Synthetic peptide
GKPGSGKPGSGKPGS

SEQ ID NO: 47 - protein, 20 aa, Artificial Sequence
  Description of Artificial Sequence: Synthetic peptide
GKPGSGKPGSGKPGSGKPGS

SEQ ID NO: 48 - protein, 20 aa, Artificial Sequence
  Description of Artificial Sequence: Synthetic peptide
GKGKSGKGKSGKGKSGKGKS

SEQ ID NO: 49 - protein, 14 aa, Artificial Sequence
  Description of Artificial Sequence: Synthetic peptide
STAGDTHLGGEDFD

SEQ ID NO: 50 - protein, 15 aa, Artificial Sequence
  Description of Artificial Sequence: Synthetic peptide
GEGGSGEGGSGEGGS

SEQ ID NO: 51 - protein, 15 aa, Artificial Sequence
  Description of Artificial Sequence: Synthetic peptide
GGEGSGGEGSGGEGS

SEQ ID NO: 52 - protein, 15 aa, Artificial Sequence
  Description of Artificial Sequence: Synthetic peptide
GEGESGEGESGEGES

SEQ ID NO: 53 - protein, 15 aa, Artificial Sequence
  Description of Artificial Sequence: Synthetic peptide
GGGESGGEGSGEGGS

SEQ ID NO: 54 - protein, 20 aa, Artificial Sequence
  Description of Artificial Sequence: Synthetic peptide
GEGESGEGESGEGESGEGES

SEQ ID NO: 55 - protein, 18 aa, Artificial Sequence
  Description of Artificial Sequence: Synthetic peptide
GSTSGSGKPGSGEGSTKG

SEQ ID NO: 56 - protein, 19 aa, Artificial Sequence
  Description of Artificial Sequence: Synthetic peptide
PRGASKSGSASQTGSAPGS

SEQ ID NO: 57 - protein, 19 aa, Artificial Sequence
  Description of Artificial Sequence: Synthetic peptide
GTAAAGAGAAGGAAAGAAG

SEQ ID NO: 58 - protein, 19 aa, Artificial Sequence
  Description of Artificial Sequence: Synthetic peptide
GTSGSSGSGSGGSGSGGGG

SEQ ID NO: 59 - protein, 20 aa, Artificial Sequence
  Description of Artificial Sequence: Synthetic peptide
GKPGSGKPGSGKPGSGKPGS

SEQ ID NO: 60 - protein, 4 aa, Artificial Sequence
  Description of Artificial Sequence: Synthetic peptide
GSGS

SEQ ID NO: 61 - protein, 10 aa, Artificial Sequence
  Description of Artificial Sequence: Synthetic peptide
APAPAPAPAP

SEQ ID NO: 62 - protein, 20 aa, Artificial Sequence
  Description of Artificial Sequence: Synthetic peptide
APAPAPAPAPAPAPAPAPAP

SEQ ID NO: 63 - protein, 32 aa, Artificial Sequence
  Description of Artificial Sequence: Synthetic polypeptide
AEAAAKEAAAKEAAAAKEAAAAKEAAAAKAAA

SEQ ID NO: 64 - protein, 16 aa, Artificial Sequence
  Description of Artificial Sequence: Synthetic peptide
GTEGKSSGSGSESKST

SEQ ID NO: 65 - protein, 243 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIK

SEQ ID NO: 66 - protein, 243 aa, Artificial Sequence
  Description of Artificial Sequence: Synthetic polypeptide
DIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS

SEQ ID NO: 67 - protein, 243 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIK

SEQ ID NO: 68 - protein, 243 aa, Artificial Sequence
  Description of Artificial Sequence: Synthetic polypeptide
DIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS

SEQ ID NO: 69 - protein, 243 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIK

SEQ ID NO: 70 - protein, 243 aa, Artificial Sequence
  Description of Artificial Sequence: Synthetic polypeptide
DIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS

SEQ ID NO: 71 - protein, 243 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIYYASESISGVPSRFSGSGSGTDFTLTISSLQPEDFATYYCQQSGSWPYTFGQGTKLEIK

SEQ ID NO: 72 - protein, 243 aa, Artificial Sequence
  Description of Artificial Sequence: Synthetic polypeptide
DIQMTQSPSSLSASVGDRVTITCRARQSIGTAIHWYQQKPGKAPKLLIYYASESISGVPSRFSGSGSGTDFTLTISSLQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS

SEQ ID NO: 73 - protein, 243 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIK

SEQ ID NO: 74 - protein, 243 aa, Artificial Sequence
  Description of Artificial Sequence: Synthetic polypeptide
DILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS

SEQ ID NO: 75 - protein, 475 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 76 - protein, 475 aa, Artificial Sequence
  Description of Artificial Sequence: Synthetic polypeptide
DIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 77 - protein, 474 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 78 - protein, 474 aa, Artificial Sequence
  Description of Artificial Sequence: Synthetic polypeptide
DIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 79 - protein, 475 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 80 - protein, 475 aa, Artificial Sequence
  Description of Artificial Sequence: Synthetic polypeptide
DIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 81 - protein, 475 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIYYASESISGVPSRFSGSGSGTDFTLTISSLQPEDFATYYCQQSGSWPYTFGQGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 82 - protein, 475 aa, Artificial Sequence
  Description of Artificial Sequence: Synthetic polypeptide
DIQMTQSPSSLSASVGDRVTITCRARQSIGTAIHWYQQKPGKAPKLLIYYASESISGVPSRFSGSGSGTDFTLTISSLQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 83 - protein, 475 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 84 - protein, 475 aa, Artificial Sequence
  Description of Artificial Sequence: Synthetic polypeptide
DILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 85 - protein, 445 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 86 - protein, 214 aa, Artificial Sequence
  Description of Artificial Sequence: Synthetic polypeptide
DIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 87 - skipped

SEQ ID NO: 88 - protein, 214 aa, Artificial Sequence
  Description of Artificial Sequence: Synthetic polypeptide
DIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 89 - skipped

SEQ ID NO: 90 - protein, 214 aa, Artificial Sequence
  Description of Artificial Sequence: Synthetic polypeptide
DIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 91 - skipped

SEQ ID NO: 92 - protein, 214 aa, Artificial Sequence
  Description of Artificial Sequence: Synthetic polypeptide
DIQMTQSPSSLSASVGDRVTITCRARQSIGTAIHWYQQKPGKAPKLLIYYASESISGVPSRFSGSGSGTDFTLTISSLQPEDFATYYCQQSGSWPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 93 - skipped

SEQ ID NO: 94 - protein, 214 aa, Artificial Sequence
  Description of Artificial Sequence: Synthetic polypeptide
DILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 95 - protein, 330 aa, Homo sapiens [sequence omitted]

SEQ ID NO: 96 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 97 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 98 - protein, 261 aa, Homo sapiens
MWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGGDSGGPLVCNGVLQGITSWGPEPCALPEKPAVYTKVVHYRKWIKDTIAANP

SEQ ID NO: 99 - protein, 91 aa, Artificial Sequence
  Description of Artificial Sequence: Synthetic polypeptide
QDGNEEMGGITQTPYKVSISGTTVILTCPQYPGSEILWQHNDKNIGGDEDDKNIGSDEDHLSLKEFSELEQSGYYVCYPRGSKPEDANFYL

SEQ ID NO: 100 - protein, 9 aa, Artificial Sequence
  Description of Artificial Sequence: Synthetic peptide
PQYPGSEIL

SEQ ID NO: 101 - protein, 9 aa, Artificial Sequence
  Description of Artificial Sequence: Synthetic peptide
GSDEDHLSL

SEQ ID NO: 102 - protein, 6 aa, Artificial Sequence
  Description of Artificial Sequence: Synthetic peptide
PRGSKP

SEQ ID NO: 103 - protein, 107 aa, Artificial Sequence
  Description of Artificial Sequence: Synthetic polypeptide
  MOD_RES (4)..(4): L or M
  MOD_RES (9)..(9): G or S
  MOD_RES (10)..(10): I or S
  MOD_RES (13)..(13): V or A
  MOD_RES (15)..(15): P or V
  MOD_RES (17)..(17): E or D
  MOD_RES (20)..(20): S or T
  MOD_RES (21)..(21): F or I
  MOD_RES (22)..(22): S or T
  MOD_RES (40)..(40): T or P
  MOD_RES (41)..(41): N or G
  MOD_RES (42)..(42): G or K
  MOD_RES (43)..(43): S or A
  MOD_RES (45)..(45): R or K
  MOD_RES (49)..(49): K or Y
  MOD_RES (58)..(58): I or V
  MOD_RES (76)..(76): N or S
  MOD_RES (78)..(78): V or L
  MOD_RES (80)..(80): S or P
  MOD_RES (83)..(83): I or F
  MOD_RES (85)..(85): D or T
  MOD_RES (92)..(92): N or G
  MOD_RES (100)..(100): G or Q
DIQXTQSPXXLSXSXGXRVXXXCRARQSIGTAIHWYQQKXXXXPXLLIXYASESISGXPSRFSGSGSGTDFTLTIXSXQXEDXAXYYCQQSXSWPYTFGXGTKLEIK

SEQ ID NO: 104 - protein, 262 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDILLTQSPGILSVSPGERVSFSCRARQSIGTAIHWYQQRTNGSPRLLIKYASESISGIPSRFSGSGSGTDFTLTINSVESEDIADYYCQQSNSWPYTFGGGTKLEIKGPGGQHHHHHHGAYPYDVPDYAS

SEQ ID NO: 105 - protein, 262 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDIQMTQSPSSLSASVGDRVTITCRARQSIGTAIHWYQQKPGKAPKLLIYYASESISGVPSRFSGSGSGTDFTLTISSLQPEDFATYYCQQSNSWPYTFGQGTKLEIKGPGGQHHHHHHGAYPYDVPDYAS

SEQ ID NO: 106 - protein, 262 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDIQMTQSPSSLSASVGDRVTITCRARQSIGTAIHWYQQKPGKAPKLLIKYASESISGVPSRFSGSGSGTDFTLTISSLQPEDFATYYCQQSNSWPYTFGQGTKLEIKGPGGQHHHHHHGAYPYDVPDYAS

SEQ ID NO: 107 - protein, 262 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDIQMTQSPSSLSASVGDRVTITCRARQSIGTAIHWYQQKPGKAPKLLIKYASESISGVPSRFSGSGSGTDFTLTISSVQPEDFATYYCQQSNSWPYTFGQGTKLEIKGPGGQHHHHHHGAYPYDVPDYAS

SEQ ID NO: 108 - protein, 262 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIKGPGGQHHHHHHGAYPYDVPDYAS

SEQ ID NO: 109 - protein, 262 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKGPGGQHHHHHHGAYPYDVPDYAS

SEQ ID NO: 110 - protein, 262 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIKGPGGQHHHHHHGAYPYDVPDYAS

SEQ ID NO: 111 - protein, 262 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDIQMTQSPSSLSASVGDRVTITCRARQSIGTAIHWYQQKPGKAPKLLIYYASESISGVPSRFSGSGSGTDFTLTISSLQPEDFATYYCQQSGSWPYTFGQGTKLEIKGPGGQHHHHHHGAYPYDVPDYAS

SEQ ID NO: 112 - protein, 262 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIKGPGGQHHHHHHGAYPYDVPDYAS

SEQ ID NO: 113 - DNA, 348 bp, Artificial Sequence
  Description of Artificial Sequence: Synthetic polynucleotide
gaggtgcaactggtggagtctgggggaggcctggtcaagcctggggggtccctgagactctcctgtgcagcctctggattcaccttcagtagatataacatgaactgggtccgccaggctccagggaaggggctggagtgggtctcatccattagtactagtagtaattacatatactacgcagactcagtgaagggccgattcaccttctccagagacaacgccaagaactcactggatctgcaaatgagcggcctgagagccgaggacacggctatttattactgtacgagaggctgggggccttttgactactggggccagggaaccctggtcaccgtctcctca

SEQ ID NO: 114 - DNA, 321 bp, Artificial Sequence
  Description of Artificial Sequence: Synthetic polynucleotide
gacatccagatgacacagtcaccttctagtttgtctgcttctgtaggcgaccgtgtaactatcacctgtcgagcccgtcaaagtattggtactgccattcactggtaccaacaaaaacctggcaaagctccaaaactcttgatctactatgcctccgaaagcatatcaggggtcccaagcagattctcaggcagtggcagtggcactgacttcactctcaccatttctagcgtgcaaccagaggacttcgccacttattactgccaacagtcagggagctggccctacaccttcggccaaggtacaaaactggagatcaaa

SEQ ID NO: 115 - DNA, 321 bp, Artificial Sequence
  Description of Artificial Sequence: Synthetic polynucleotide
gacatacaaatgacacaatcaccctcttctctttctgcaagcgttggcgaccgtgtcactatcacttgtcgagcccgccagtccataggtactgccattcactggtatcaacagaagcctggcaaggctcccaaactcctgattaagtatgccagcgagagcatttccggcgtaccttcaagattttccggctccggtagtgggacagatttcactctcactatatctagcctccaaccagaagatttcgccacttactactgtcaacaatcaggttcatggccttacactttcggccaggggacaaaattggagatcaag

SEQ ID NO: 116 - DNA, 321 bp, Artificial Sequence
  Description of Artificial Sequence: Synthetic polynucleotide
gacatccaaatgactcaatcacctagcagcctctccgcctccgttggagatagagtgacaataacttgccgagcccggcaaagtatcggaactgctattcactggtatcaacaaaaacctggaaaggcacctaagctcttgattaaatacgcttctgagtccatctccggcgtgccttcacgattcagcggcagcggtagtggtactgactttaccctcactattagttctgttcagccagaggacttcgcaacttattactgccaacagagtggttcctggccatacacttttggccaggggactaaattggaaatcaaa

SEQ ID NO: 117 - DNA, 321 bp, Artificial Sequence
  Description of Artificial Sequence: Synthetic polynucleotide
gacatccaaatgactcaaagcccctctagtttgagtgcatctgtaggtgaccgggtaacaatcacctgccgtgcccggcaaagtataggtactgcaatccactggtaccagcaaaaacccggcaaagcaccaaagctgctcatatactatgctagtgagagcatttctggcgttcctagtcgattttctggatcagggagtggaactgattttacactgacaatcagcagcctccaacccgaagacttcgccacctactattgtcagcagtctgggtcctggccttacacattcggtcaaggaactaaattggagatcaaa

SEQ ID NO: 118 - DNA, 321 bp, Artificial Sequence
  Description of Artificial Sequence: Synthetic polynucleotide
gacattttgctgacacagagccctggtatcctctcagtcagtccaggggaacgcgtttcatttagctgccgtgctcgacagagcattgggaccgcaatccactggtaccaacaaagaactaacggttcaccacggcttttgattaagtatgcctccgaatccatcagtggcattcctagtcgtttttctggatcaggatcaggcaccgactttactctcacaattaatagtgtcgaaagtgaggacattgcagactattattgtcagcaatccggttcctggccctatacttttggtggtggtactaagttggaaattaaa

SEQ ID NO: 119 - protein, 107 aa, Artificial Sequence
  Description of Artificial Sequence: Synthetic polypeptide
DILLTQSPGILSVSPGERVSFSCRARQSIGTAIHWYQQRTNGSPRLLIKYASESISGIPSRFSGSGSGTDFTLTINSVESEDIADYYCQQSNSWPYTFGGGTKLEIK

SEQ ID NO: 120 - DNA, 321 bp, Artificial Sequence
  Description of Artificial Sequence: Synthetic polynucleotide
gatatacttcttacccagagtcccggcatcctctccgttagccctggggagagagtctcattctcatgccgagccagacagtcaattggtaccgcaatacactggtatcaacagcggaccaatggttctccccgacttctgataaagtacgcatcagaatcaattagtggaataccatcaagatttagtggctcagggagtggaaccgattttactctgaccatcaactcagtggaatctgaggacattgccgactactactgtcaacaaagcaatagttggccatataccttcggaggcggaactaaattggagataaaa

SEQ ID NO: 121 - protein, 9 aa, Artificial Sequence
  Description of Artificial Sequence: Synthetic peptide
QQSNSWPYT

SEQ ID NO: 122 - protein, 6 aa, Artificial Sequence
  Description of Artificial Sequence: Synthetic peptide
SNSWPY

SEQ ID NO: 123 - protein, 9 aa, Artificial Sequence
  Description of Artificial Sequence: Synthetic peptide
QQSNSWPYT

SEQ ID NO: 124 - protein, 117 aa, Artificial Sequence
  Description of Artificial Sequence: Synthetic polypeptide
QVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSS

SEQ ID NO: 125 - protein, 111 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTISSLQAEDVAVYYCQQTRKVPYTFGQGTKLEIK

SEQ ID NO: 126 - protein, 117 aa, Artificial Sequence
  Description of Artificial Sequence: Synthetic polypeptide
DVQLQESGPGLVKPSQSLSLTCTVTGNSITSDYAWNWIRQFPGNRLEWMGYISYSGSTTYSPSLKSRFSITRDTSKNQFFLQLNSVTPEDTATYFCATGYYYGSGFWGQGTLVTVSS

SEQ ID NO: 127 - protein, 111 aa, Artificial Sequence
  Description of Artificial Sequence: Synthetic polypeptide
DIVLTQSPASLAVSLGQRATISCRASESVEYFGTSLMHWYRQKPGQPPKLLIYAASNVESGVPARFSGSGSGTDFSLNIQPVEEDDFSMYFCQQTRKVPYTFGGGTKLEIK

SEQ ID NO: 128 - protein, 117 aa, Artificial Sequence
  Description of Artificial Sequence: Synthetic polypeptide
QVQLQESGPGLVKPSDTLSLTCAVSGNSITSDYAWNWIRQFPGKGLEWIGYISYSGSTTYNPSLKSRVTISRDTSKNQFSLKLSSVTPVDTAVYYCATGYYYGSGFWGQGTLVTVSS

SEQ ID NO: 129 - protein, 111 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTIQSVQAEDVSVYFCQQTRKVPYTFGQGTKLEIK

SEQ ID NO: 130 - protein, 117 aa, Artificial Sequence
  Description of Artificial Sequence: Synthetic polypeptide
QVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSS

SEQ ID NO: 131 - protein, 111 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIK

SEQ ID NO: 132 - protein, 117 aa, Artificial Sequence
  Description of Artificial Sequence: Synthetic polypeptide
QVQLQESGPGLVKPSQTLSLTCTVSGNSITSDYAWNWIRQFPGKGLEWIGYISYSGSTTYNPSLKSRVTISRDTSKNQFSLKLSSVTAADTAVYYCATGYYYGSGFWGQGTLVTVSS

SEQ ID NO: 133 - protein, 111 aa, Artificial Sequence
  Description of Artificial Sequence: Synthetic polypeptide
DIVLTQSPDSLAVSLGERATINCRASESVEYFGTSLMHWYQQKPGQPPKLLIYAASNVESGVPDRFSGSGSGTDFTLTISSLQAEDVAVYFCQQTRKVPYTFGGGTKVEIK

SEQ ID NO: 134 - protein, 117 aa, Artificial Sequence
  Description of Artificial Sequence: Synthetic polypeptide
QVQLQESGPGLVKPSQTLSLTCTVSGNSITSDYAWNWIRQPPGKGLEWIGYISYSGSTTYNPSLKSRVTISRDTSKNQFSLKLSSVTAADTAVYYCATGYYYGSGFWGQGTLVTVSS

SEQ ID NO: 135 - protein, 111 aa, Artificial Sequence
  Description of Artificial Sequence: Synthetic polypeptide
EIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIK

SEQ ID NO: 136 - protein, 117 aa, Artificial Sequence
  Description of Artificial Sequence: Synthetic polypeptide
QVQLQESGPGLVKPSQTLSLTCTVSGNSITSDYAWNWIRQFPGKRLEWIGYISYSGSTTYNPSLKSRVTISRDTSKNQFSLKLSSVTAADTAVYYCATGYYYGSGFWGQGTLVTVSS

SEQ ID NO: 137 - protein, 124 aa, Artificial Sequence
  Description of Artificial Sequence: Synthetic polypeptide
EVQLVESGGGLVQPGGSLRLSCAASGFTFSSYWMTWVRQAPGKGLEWVANIKQDGSERYYVDSVKGRFTISRDNAKNSLYLQMNSLRAEDTAVYYCARDQNYDILTGHYGMDVWGQGTTVTVSS

SEQ ID NO: 138 - protein, 107 aa, Artificial Sequence
  Description of Artificial Sequence: Synthetic polypeptide
EIVLTQSPSFLSASVGDRVTITCRASQGISSYLSWYQQKPGKAPKLLIYATSTLQSGVPSRFSGSGSGTEFTLTISSLQPEDFATYYCQQLNSYPRTFGQGTKVEIK

SEQ ID NO: 139 - protein, 125 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSS

SEQ ID NO: 140 - protein, 107 aa, Artificial Sequence
  Description of Artificial Sequence: Synthetic polypeptide
DIQMTQSPSFLSASVGDRVTITCRASQGISSYLAWYQQKPGKAPKFLIYAASTLQSGVPSRFSGSGSGTEFTLTISSLQPEDFATYYCQQLNSYPLTFGGGTKVEIK

SEQ ID NO: 141 - protein, 123 aa, Artificial Sequence
  Description of Artificial Sequence: Synthetic polypeptide
EVQLVESGGGVVQPGRSLRLSCVASGFTFSSYDIHWVRQAPGKGLEWVAIISYDGSKKDYTDSVKGRFTISRDNSKNTLYLQMDSLRVEDSAVYSCARESGWSHYYYYGMDVWGQGTMVTVSS

SEQ ID NO: 142 - protein, 107 aa, Artificial Sequence
  Description of Artificial Sequence: Synthetic polypeptide
DIVMTQSPSSLSASVGDRVTITCRASQDISNYLAWYQQKPGKVPKFLIYAASTLHSGVPSRFSGSGSGTDFTLTISSLQPEDVATYYCQKYNSAPYTFGQGTRLEIK

SEQ ID NO: 143 - protein, 119 aa, Artificial Sequence
  Description of Artificial Sequence: Synthetic polypeptide
QVQLQESGPGLVKPSETLSLTCTVSGGSISSYYWSWLRQPAGSGLEWIGRLYVSGFTNYNPSLKSRVTLSLDPSRNQLSLKLSSVTAADTAVYYCAGDSGNYWGWFDPWGQGTLVTVSS

SEQ ID NO: 144 - protein, 106 aa, Artificial Sequence
  Description of Artificial Sequence: Synthetic polypeptide
SYELTQPPSVSVSPGETASITCSGDQLGENYACWYQQKPGQSPVLVIYQDSKRPSGIPERFSGSNSGNTATLTISGTQALDEADYYCQAWDNSIVVFGGGTKLTVL

SEQ ID NO: 145 - protein, 121 aa, Artificial Sequence
  Description of Artificial Sequence: Synthetic polypeptide
QVQLVESGGGVVQPGRSLRLSCAASGFTFSYYGMHWVRQAPGKGLEWVAFISYDGSNKYYADSVKGRFTISRDNSKNTLYLQMNSLRAEDTAVYYCAHLPYSGSYWAFDYWGQGTQVTVSS

SEQ ID NO: 146 - protein, 108 aa, Artificial Sequence
  Description of Artificial Sequence: Synthetic polypeptide
QSVLTQPPSVSVAPGQTASITCGGDNIGSKSVHWYQQKPGQAPVLVVYDNSDRPSGIPERFSGSNSGTTATLTISRVEAGDEADYYCQVWDSSSDHPVVFGGGTKVTV

SEQ ID NO: 147 - protein, 125 aa, Artificial Sequence
  Description of Artificial Sequence: Synthetic polypeptide
QVQLVESGGGLVQPGGSLRLSCAASGFTFSHYAMSWVRQAPGKGLEWVSTIGGSGGSTYYADSVKGRFTISRDNSKNTLYLQMNSLRAEDTAVYYCAKPHIVMVTALLYDGMDVWGQGTMVTVSS

SEQ ID NO: 148 - protein, 108 aa, Artificial Sequence
  Description of Artificial Sequence: Synthetic polypeptide
SSELTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVL

SEQ ID NO: 149 - protein, 6 aa, Artificial Sequence
  Description of Artificial Sequence: Synthetic peptide
SDYAWN

SEQ ID NO: 150 - protein, 16 aa, Artificial Sequence
  Description of Artificial Sequence: Synthetic peptide
YISYSGSTTYSPSLKS

SEQ ID NO: 151 - protein, 8 aa, Artificial Sequence
  Description of Artificial Sequence: Synthetic peptide
GYYYGSGF

SEQ ID NO: 152 - protein, 16 aa, Artificial Sequence
  Description of Artificial Sequence: Synthetic peptide
YISYSGSTTYNPSLKS

SEQ ID NO: 153 - protein, 5 aa, Artificial Sequence
  Description of Artificial Sequence: Synthetic peptide
SYWMT

SEQ ID NO: 154 - protein, 17 aa, Artificial Sequence
  Description of Artificial Sequence: Synthetic peptide
NIKQDGSERYYVDSVKG

SEQ ID NO: 155 - protein, 15 aa, Artificial Sequence
  Description of Artificial Sequence: Synthetic peptide
DQNYDILTGHYGMDV

SEQ ID NO: 156 - protein, 5 aa, Artificial Sequence
  Description of Artificial Sequence: Synthetic peptide
SYYWS

SEQ ID NO: 157 - protein, 16 aa, Artificial Sequence
  Description of Artificial Sequence: Synthetic peptide
YIYYSGSTNYNPSLKS

SEQ ID NO: 158 - protein, 17 aa, Artificial Sequence
  Description of Artificial Sequence: Synthetic peptide
TTIFGVVTPNFYYGMDV

SEQ ID NO: 159 - protein, 5 aa, Artificial Sequence
  Description of Artificial Sequence: Synthetic peptide
SYDIH

SEQ ID NO: 160 - protein, 17 aa, Artificial Sequence
  Description of Artificial Sequence: Synthetic peptide
IISYDGSKKDYTDSVKG

SEQ ID NO: 161 - protein, 14 aa, Artificial Sequence
  Description of Artificial Sequence: Synthetic peptide
ESGWSHYYYYGMDV

SEQ ID NO: 162 - protein, 5 aa, Artificial Sequence
  Description of Artificial Sequence: Synthetic peptide
SYYWS

SEQ ID NO: 163 - protein, 16 aa, Artificial Sequence
  Description of Artificial Sequence: Synthetic peptide
RLYVSGFTNYNPSLKS

SEQ ID NO: 164 - protein, 11 aa, Artificial Sequence
  Description of Artificial Sequence: Synthetic peptide
DSGNYWGWFDP

SEQ ID NO: 165 - protein, 5 aa, Artificial Sequence
  Description of Artificial Sequence: Synthetic peptide
YYGMH

SEQ ID NO: 166 - protein, 17 aa, Artificial Sequence
  Description of Artificial Sequence: Synthetic peptide
FISYDGSNKYYADSVKG

SEQ ID NO: 167 - protein, 12 aa, Artificial Sequence
  Description of Artificial Sequence: Synthetic peptide
LPYSGSYWAFDY

SEQ ID NO: 168 - protein, 5 aa, Artificial Sequence
  Description of Artificial Sequence: Synthetic peptide
HYAMS

SEQ ID NO: 169 - protein, 17 aa, Artificial Sequence
  Description of Artificial Sequence: Synthetic peptide
TIGGSGGSTYYADSVKG

SEQ ID NO: 170 - protein, 16 aa, Artificial Sequence
  Description of Artificial Sequence: Synthetic peptide
PHIVMVTALLYDGMDV

SEQ ID NO: 171 - protein, 15 aa, Artificial Sequence
  Description of Artificial Sequence: Synthetic peptide
RASESVEYFGTSLMH

SEQ ID NO: 172 - protein, 7 aa, Artificial Sequence
  Description of Artificial Sequence: Synthetic peptide
AASNVES

SEQ ID NO: 173 - protein, 9 aa, Artificial Sequence
  Description of Artificial Sequence: Synthetic peptide
QQTRKVPYT

SEQ ID NO: 174 - protein, 15 aa, Artificial Sequence
  Description of Artificial Sequence: Synthetic peptide
KASESVEYFGTSLMH

SEQ ID NO: 175 - protein, 7 aa, Artificial Sequence
  Description of Artificial Sequence: Synthetic peptide
AASNRES

SEQ ID NO: 176 - protein, 11 aa, Artificial Sequence
  Description of Artificial Sequence: Synthetic peptide
RASQGISSYLS

SEQ ID NO: 177 - protein, 7 aa, Artificial Sequence
  Description of Artificial Sequence: Synthetic peptide
ATSTLQS

SEQ ID NO: 178 - protein, 9 aa, Artificial Sequence
  Description of Artificial Sequence: Synthetic peptide
QQLNSYPRT

SEQ ID NO: 179 - protein, 11 aa, Artificial Sequence
  Description of Artificial Sequence: Synthetic peptide
RASQDISNYLA

SEQ ID NO: 180 - protein, 7 aa, Artificial Sequence
  Description of Artificial Sequence: Synthetic peptide
AASTLHS

SEQ ID NO: 181 - protein, 9 aa, Artificial Sequence
  Description of Artificial Sequence: Synthetic peptide
QKYNSAPYT

SEQ ID NO: 182 - protein, 11 aa, Artificial Sequence
  Description of Artificial Sequence: Synthetic peptide
RASQGISSYLA

SEQ ID NO: 183 - protein, 7 aa, Artificial Sequence
  Description of Artificial Sequence: Synthetic peptide
AASTLQS

SEQ ID NO: 184 - protein, 9 aa, Artificial Sequence
  Description of Artificial Sequence: Synthetic peptide
QQLNSYPLT

SEQ ID NO: 185 - protein, 11 aa, Artificial Sequence
  Description of Artificial Sequence: Synthetic peptide
SGDQLGENYAC

SEQ ID NO: 186 - protein, 7 aa, Artificial Sequence
  Description of Artificial Sequence: Synthetic peptide
QDSKRPS

SEQ ID NO: 187 - protein, 9 aa, Artificial Sequence
  Description of Artificial Sequence: Synthetic peptide
QAWDNSIVV

SEQ ID NO: 188 - protein, 11 aa, Artificial Sequence
  Description of Artificial Sequence: Synthetic peptide
QVWDSSSDHVV

SEQ ID NO: 189 - protein, 10 aa, Artificial Sequence
  Description of Artificial Sequence: Synthetic peptide
GFTFSSYWMT

SEQ ID NO: 190 - protein, 10 aa, Artificial Sequence
  Description of Artificial Sequence: Synthetic peptide
NIKQDGSERY

SEQ ID NO: 191 - protein, 11 aa, Artificial Sequence
  Description of Artificial Sequence: Synthetic peptide
GGNNIGSKSVH

SEQ ID NO: 192 - protein, 7 aa, Artificial Sequence
  Description of Artificial Sequence: Synthetic peptide
DDSDRPS

SEQ ID NO: 193 - protein, 12 aa, Artificial Sequence
  Description of Artificial Sequence: Synthetic peptide
QVWDSSSDHPVV

SEQ ID NO: 194 - protein, 11 aa, Artificial Sequence
  Description of Artificial Sequence: Synthetic peptide
GNSITSDYAWN

SEQ ID NO: 195 - protein, 9 aa, Artificial Sequence
  Description of Artificial Sequence: Synthetic peptide
YISYSGSTT

SEQ ID NO: 196 - protein, 10 aa, Artificial Sequence
  Description of Artificial Sequence: Synthetic peptide
GFTFSSYDIH

SEQ ID NO: 197 - protein, 10 aa, Artificial Sequence
  Description of Artificial Sequence: Synthetic peptide
IISYDGSKKD

SEQ ID NO: 198 - protein, 10 aa, Artificial Sequence
  Description of Artificial Sequence: Synthetic peptide
GGSISSYYWS

SEQ ID NO: 199 - protein, 9 aa, Artificial Sequence
  Description of Artificial Sequence: Synthetic peptide
RLYVSGFTN

SEQ ID NO: 200 - protein, 7 aa, Artificial Sequence
  Description of Artificial Sequence: Synthetic peptide
GFTFSYY

SEQ ID NO: 201 - protein, 10 aa, Artificial Sequence
  Description of Artificial Sequence: Synthetic peptide
FISYDGSNKY

SEQ ID NO: 202 - protein, 10 aa, Artificial Sequence
  Description of Artificial Sequence: Synthetic peptide
GGSISSYYWS

SEQ ID NO: 203 - protein, 9 aa, Artificial Sequence
  Description of Artificial Sequence: Synthetic peptide
YIYYSGSTN

SEQ ID NO: 204 - protein, 10 aa, Artificial Sequence
  Description of Artificial Sequence: Synthetic peptide
GFTFSHYAMS

SEQ ID NO: 205 - protein, 11 aa, Artificial Sequence
  Description of Artificial Sequence: Synthetic peptide
TIGGSGGSTYY

SEQ ID NO: 206 - protein, 16 aa, Artificial Sequence
  Description of Artificial Sequence: Synthetic peptide
PHIVMVTALLYDGMDV

SEQ ID NO: 207 - protein, 447 aa, Artificial Sequence
  Description of Artificial Sequence: Synthetic polypeptide
DVQLQESGPGLVKPSQSLSLTCTVTGNSITSDYAWNWIRQFPGNRLEWMGYISYSGSTTYSPSLKSRFSITRDTSKNQFFLQLNSVTPEDTATYFCATGYYYGSGFWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 208 - protein, 447 aa, Artificial Sequence
  Description of Artificial Sequence: Synthetic polypeptide
QVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 209 - protein, 5 aa, Artificial Sequence
  Description of Artificial Sequence: Synthetic peptide
KVTEF

SEQ ID NO: 210 - protein, 452 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 211 - protein, 450 aa, Artificial Sequence
  Description of Artificial Sequence: Synthetic polypeptide
EVQLVESGGGVVQPGRSLRLSCVASGFTFSSYDIHWVRQAPGKGLEWVAIISYDGSKKDYTDSVKGRFTISRDNSKNTLYLQMDSLRVEDSAVYSCARESGWSHYYYYGMDVWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 212 - protein, 446 aa, Artificial Sequence
  Description of Artificial Sequence: Synthetic polypeptide
QVQLQESGPGLVKPSETLSLTCTVSGGSISSYYWSWLRQPAGSGLEWIGRLYVSGFTNYNPSLKSRVTLSLDPSRNQLSLKLSSVTAADTAVYYCAGDSGNYWGWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 213 - protein, 451 aa, Artificial Sequence
  Description of Artificial Sequence: Synthetic polypeptide
QVQLVESGGGVVQPGRSLRLSCAASGFTFSYYGMHWVRQAPGKGLEWVAFISYDGSNKYYADSVKGRFTISRDNSKNTLYLQMNSLRAEDTAVYYCAHLPYSGSYWAFDYWGQGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 214 - protein, 218 aa, Artificial Sequence
  Description of Artificial Sequence: Synthetic polypeptide
DIVLTQSPASLAVSLGQRATISCRASESVEYFGTSLMHWYRQKPGQPPKLLIYAASNVESGVPARFSGSGSGTDFSLNIQPVEEDDFSMYFCQQTRKVPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 215 - protein, 218 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTISSLQAEDVAVYYCQQTRKVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 216 - protein, 5 aa, Artificial Sequence
  Description of Artificial Sequence: Synthetic peptide
HYRKW

SEQ ID NO: 217 - protein, 6 aa, Artificial Sequence
  Description of Artificial Sequence: Synthetic peptide
SHGWAH

SEQ ID NO: 218 - protein, 15 aa, Artificial Sequence
  Description of Artificial Sequence: Synthetic peptide
RHNLFEPEDTGQRVP

SEQ ID NO: 219 - protein, 455 aa, Artificial Sequence
  Description of Artificial Sequence: Synthetic polypeptide
QVQLVESGGGLVQPGGSLRLSCAASGFTFSHYAMSWVRQAPGKGLEWVSTIGGSGGSTYYADSVKGRFTISRDNSKNTLYLQMNSLRAEDTAVYYCAKPHIVMVTALLYDGMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 220 - protein, 214 aa, Artificial Sequence
  Description of Artificial Sequence: Synthetic polypeptide
SSELTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 221 - protein, 214 aa, Artificial Sequence
  Description of Artificial Sequence: Synthetic polypeptide
DIQMTQSPSFLSASVGDRVTITCRASQGISSYLAWYQQKPGKAPKFLIYAASTLQSGVPSRFSGSGSGTEFTLTISSLQPEDFATYYCQQLNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 222 - protein, 214 aa, Artificial Sequence
  Description of Artificial Sequence: Synthetic polypeptide
DIVMTQSPSSLSASVGDRVTITCRASQDISNYLAWYQQKPGKVPKFLIYAASTLHSGVPSRFSGSGSGTDFTLTISSLQPEDVATYYCQKYNSAPYTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 223 - protein, 212 aa, Artificial Sequence
  Description of Artificial Sequence: Synthetic polypeptide
SYELTQPPSVSVSPGETASITCSGDQLGENYACWYQQKPGQSPVLVIYQDSKRPSGIPERFSGSNSGNTATLTISGTQALDEADYYCQAWDNSIVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 224 - protein, 215 aa, Artificial Sequence
  Description of Artificial Sequence: Synthetic polypeptide
QSVLTQPPSVSVAPGQTASITCGGDNIGSKSVHWYQQKPGQAPVLVVYDNSDRPSGIPERFSGSNSGTTATLTISRVEAGDEADYYCQVWDSSSDHPVVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 225 - DNA, 351 bp, Artificial Sequence
  Description of Artificial Sequence: Synthetic polynucleotide
gatgtgcagcttcaggagtctggacccggacttgttaaaccaagtcagtctctgtccctgacctgtaccgtcaccggcaacagcatcacaagcgattacgcatggaactggatcaggcagttccctggaaatcgactcgaatggatgggctacatttcatactccggttcaaccacttactctccatccttgaaatctaggttcagcatcacccgtgatacctcaaagaaccaattttttctgcaactgaatagcgtaactccagaggacacagccacatatttctgcgccactgggtattactatggctcaggtttctggggtcagggcactctcgtcaccgtcagcagc

SEQ ID NO: 226 - DNA, 351 bp, Artificial Sequence
  Description of Artificial Sequence: Synthetic polynucleotide
caggtccaactgcaagagagcggaccgggcctggtaaagccatccgacacattgtccctgacgtgtgcggtaagtggaaactctatcactagcgactatgcgtggaattggataagacaaccgccgggcaaggggctggaatggataggatatatcagctattccggttctacgacatacaatccttccctgaaaagcagagtcactatgtcacgcgacacgtccaagaatcagttctcattgaaattgtcatccgtaacggccgttgacactgcggtttattattgcgcaaccggatattactacggctctggtttttggggacagggaacacttgttactgttagttca

SEQ ID NO: 227 - DNA, 351 bp, Artificial Sequence
  Description of Artificial Sequence: Synthetic polynucleotide
caggtgcagctgcaggagagcggcccaggcctggtgaagccaagcgacaccctgagcctgacctgcgccgtgagcggcaacagcatcaccagcgactacgcctggaactggatccgccagttcccaggcaagggcctggagtggatcggctacatcagctacagcggcagcaccacctacaacccaagcctgaagagccgcgtcaccatcagccgcgacaccagcaagaaccagttcagcctgaagctgagcagcgtgacccctgtggacaccgccgtgtactactgcgccaccggctactactacggcagcggcttctggggccagggcaccctggtgaccgtgagcagc

SEQ ID NO: 228 - DNA, 351 bp, Artificial Sequence
  Description of Artificial Sequence: Synthetic polynucleotide
caggtgcagctgcaggagagcggcccaggcctggtgaagccaagcgacaccctgagcctgacctgcgccgtgagcggcaacagcatcaccagcgactacgcctggaactggatccgccagttcccaggcaagggcctggagtggatgggctacatcagctacagcggcagcaccacctacaacccaagcctgaagagccgcgtcaccatcagccgcgacaccagcaagaaccagttcagcctgaagctgagcagcgtgacccctgtggacaccgccgtgtactactgcgccaccggctactactacggcagcggcttctggggccagggcaccctggtgaccgtgagcagc

SEQ ID NO: 229 - DNA, 351 bp, Artificial Sequence
  Description of Artificial Sequence: Synthetic polynucleotide
caggttcagctgcaagagtctggaccaggcctggtcaagccctctcagaccctgtctctgacctgtaccgtgtccggcaactccatcacctctgactacgcctggaactggattcggcagttccctggcaagggccttgagtggatcggctacatctcctactccggttccaccacctacaaccccagcctgaagtcccgggtcaccatctcccgcgacacctccaagaaccagttctccctgaagctgtcctccgtgaccgctgctgataccgccgtgtactactgtgccaccggctactactacggctccggcttttggggacagggcacactggttaccgtgtctagt

SEQ ID NO: 230 - DNA, 351 bp, Artificial Sequence
  Description of Artificial Sequence: Synthetic polynucleotide
caggttcagctgcaagagtctggaccaggcctggtcaagccctctcagaccctgtctctgacctgtaccgtgtccggcaactccatcacctctgactacgcctggaactggattcggcagccacctggcaagggccttgagtggatcggctacatctcctactccggttccaccacctacaaccccagcctgaagtcccgggtcaccatctcccgcgacacctccaagaaccagttctccctgaagctgtcctccgtgaccgctgctgataccgccgtgtactactgtgccaccggctactactacggctccggcttttggggacagggcacactggttaccgtgtctagt

SEQ ID NO: 231 - DNA, 351 bp, Artificial Sequence
  Description of Artificial Sequence: Synthetic polynucleotide
caggttcagctgcaagagtctggaccaggcctggtcaagccctctcagaccctgtctctgacctgtaccgtgtccggcaactccatcacctctgactacgcctggaactggattcggcagttccctggcaagcgccttgagtggatcggctacatctcctactccggttccaccacctacaaccccagcctgaagtcccgggtcaccatctcccgcgacacctccaagaaccagttctccctgaagctgtcctccgtgaccgctgctgataccgccgtgtactactgtgccaccggctactactacggctccggcttttggggacagggcacactggttaccgtgtctagt

SEQ ID NO: 232 - DNA, 372 bp, Artificial Sequence
  Description of Artificial Sequence: Synthetic polynucleotide
gaggtgcaacttgtggagagcggcggaggtctggtccaacccggaggaagtctccgtctctcctgtgctgctagtggcttcactttcagctcatattggatgacatgggtgagacaagccccaggaaaggggctcgagtgggtagctaacattaaacaggacggctccgaacggtactatgttgattctgtgaagggacggttcactatatccagggataatgcaaaaaattcactctatcttcaaatgaactcactcagagcagaggacactgccgtgtattattgcgccagggatcaaaattatgacatactgaccggtcattatggaatggatgtttggggccagggaacaaccgttaccgtctcaagt

SEQ ID NO: 233 - DNA, 357 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttactattggagctggctccggcagcccgccgggtcgggactggagtggattgggcgtttatatgtcagtgggttcaccaactacaacccctccctcaagagtcgagtcaccttgtcactagacccgtccaggaaccagttgtccctgaaactgagttctgtgaccgccgcggacacggccgtatattattgtgcgggagatagtgggaactactggggttggttcgacccctggggccagggaaccctggtcaccgtctcctca

SEQ ID NO: 234 - DNA, 369 bp, Artificial Sequence
  Description of Artificial Sequence: Synthetic polynucleotide
gaggtgcagctggtggagtctgggggaggcgtggtccagcctgggaggtccctgagactctcctgtgtagcctctggattcaccttcagtagttatgacatacactgggtccgccaggctccaggcaaggggctggagtgggtggcaattatttcatatgatggaagtaaaaaagactatacagactccgtgaagggccgattcaccatctccagagacaattccaagaacacgctgtatctgcaaatggacagcctgagagttgaggactcggctgtgtattcctgtgcgagagaaagtggctggtcccactactactattacggtatggacgtctggggccaagggacaatggtcaccgtctcttca

SEQ ID NO: 235 - DNA, 375 bp, Artificial Sequence
  Description of Artificial Sequence: Synthetic polynucleotide
caggtgcagctggtggagtctgggggaggcttggtacagcctggggggtccctgagactctcctgtgcagcctctggattcacctttagtcattatgccatgagctgggtccgccaggctccagggaaggggctggagtgggtctcaactattggtggtagtggtggtagcacatactacgcagactccgtgaagggccggttcaccatctccagagacaattccaagaacacgctgtatctgcaaatgaacagcctgagagccgaggacacggccgtatattactgtgcgaaacctcatattgtaatggtgactgctcttctctacgacggtatggacgtctggggccaagggacaatggtcaccgtctcctca

SEQ ID NO: 236 - DNA, 324 bp, Artificial Sequence
  Description of Artificial Sequence: Synthetic polynucleotide
tcttctgagctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatgtggtattcggcggagggaccaagctgaccgtccta

SEQ ID NO: 237 - DNA, 333 bp, Artificial Sequence
  Description of Artificial Sequence: Synthetic polynucleotide
gacattgtgctgacacagagtccagcatccttggcagtatctttggggcagcgggcaacaatttcatgccgtgcatctgaaagtgtggagtattttggaacttctcttatgcactggtatcgccagaagcctgggcagcctcccaaactccttatatatgccgcttccaacgtggagtccggagtaccagcacgcttttccggctctgggtccggcacagacttttccctcaatatccaacctgttgaagaagacgatttttccatgtatttttgccaacagacacgcaaggttccatatacattcggcggcggcactaaacttgagatcaaa

SEQ ID NO: 238 - DNA, 333 bp, Artificial Sequence
  Description of Artificial Sequence: Synthetic polynucleotide
gacatagtcttgactcagagcccggattcccttgctgtgtctctgggagaacgagctacgatcaactgcaaggcaagtgaatccgtagaatacttcgggacatcattgatgcattggtatcaacagaaaccggggcaaccgcccaaattgctgatatatgcggctagtaatagagaatcaggagtaccggataggtttagtggttcaggatcaggtacagatttcaccctgacaataagtagcttgcaagccgaagacgtagcagtgtattactgccaacaaacccgaaaggtgccatatacgtttggacagggtacaaagttggaaatcaaa

SEQ ID NO: 239 - DNA, 333 bp, Artificial Sequence
  Description of Artificial Sequence: Synthetic polynucleotide
gacatcgtgctgacccagagcccagacagcctggccgtgagcctgggcgagcgcgccaccatcaactgcaaggccagcgagagcgtggagtacttcggcaccagcctgatgcactggtaccagcagaagccaggccagccaccaaagctgctgatctacgctgccagcaaccgcgagagcggcgtgccagaccgcttcagcggcagcggcagcggcaccgacttcaccctgaccatccagagcgtgcaggccgaggacgtctccgtgtacttctgccagcagacccgcaaggtgccatacaccttcggccagggcaccaagctggagatcaag

SEQ ID NO: 240 - DNA, 333 bp, Artificial Sequence
  Description of Artificial Sequence: Synthetic polynucleotide
gacatcgtgctgacccagagcccagacagcctggccgtgagcctgggcgagcgcgccaccatcaactgcaaggccagcgagagcgtggagtacttcggcaccagcctgatgcactggtaccagcagaagccaggccagccaccaaagctgctgatctacgctgccagcaaccgcgagagcggcgtgccagaccgcttcagcggcagcggcagcggcaccgacttcaccctgaccatcagcagcgtgcaggccgaggacgtcgccgtgtactactgccagcagacccgcaaggtgccatacaccttcggccagggcaccaagctggagatcaag

SEQ ID NO: 241 - DNA, 333 bp, Artificial Sequence
  Description of Artificial Sequence: Synthetic polynucleotide
gacatcgtgctgacccagtctccagactctctggctgtgtctctgggcgagagagccaccatcaactgcagagcctccgagtccgtggaatacttcggcacctctctgatgcactggtaccagcagaagcccggccagcctcctaagctgctgatctacgccgcctccaacgtggaatctggcgtgcccgatagattttccggctctggctctggcaccgactttaccctgaccatcagctctctgcaggccgaggatgtggccgtgtacttctgtcagcagacccggaaggtgccctacacatttggcggcggaacaaaggtggaaatcaag

SEQ ID NO: 242 - DNA, 333 bp, Artificial Sequence
  Description of Artificial Sequence: Synthetic polynucleotide
gagatcgtgctgacccagtctcctgccacactgtcactgtctccaggcgagagagccaccctctcttgtagagcctccgagtccgtggaatacttcggcacctctctgatgcactggtaccagcagaagcccggccagcctcctagactgctgatctacgccgcctccaacgtcgaatctggcatccccgctagattctccggctctggctctggcacagactttaccctgaccatctcctccgtggaacccgaggatttcgctgtgtacttttgccagcagacccggaaggtgccctacacatttggcggcggaacaaaggtggaaatcaag

SEQ ID NO: 243 - DNA, 321 bp, Artificial Sequence
  Description of Artificial Sequence: Synthetic polynucleotide
gaaatcgtactgacccagtccccttctttcttgagtgcatcagttggggatagagtgaccattacttgtagagcatctcaaggtatttcttcatacttgtcttggtatcaacaaaaacctggcaaggcacccaaactcttgatctacgccacctctacattgcaaagtggggttccttctaggttttcaggctccggctctggtaccgagttcaccctcactataagcagtctccaacctgaagatttcgctacttattattgtcagcagcttaattcttatccccgaacctttggtcaaggaactaaggtcgagatcaaa

SEQ ID NO: 244 - DNA, 321 bp, Artificial Sequence
  Description of Artificial Sequence: Synthetic polynucleotide
gacatccagatgacccagtctccttccttcctgtctgcatctgtaggagacagagtcaccatcacttgccgggccagtcagggcattagcagttatttagcctggtatcagcaaaaaccagggaaagcccctaagttcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctctcactttcggcggagggaccaaggtggaaatcaaa

SEQ ID NO: 245 - DNA, 321 bp, Artificial Sequence
  Description of Artificial Sequence: Synthetic polynucleotide
gacatcgtgatgacccagtctccatcctccctgtctgcatctgtaggagacagagtcaccatcacttgccgggcgagtcaggacattagcaattatttagcctggtatcagcagaaaccagggaaagttcctaagttcctgatctatgctgcatccactttgcactctggggtcccatctcggttcagtggcagtggatctgggacagatttcactctcaccatcagcagcctgcagcctgaagatgttgcaacttattactgtcaaaagtataacagtgccccgtacacttttggccaagggacacgactggagattaaa

SEQ ID NO: 246 - DNA, 318 bp, Artificial Sequence
  Description of Artificial Sequence: Synthetic polynucleotide
tcctatgagctgactcagccaccctcagtgtccgtgtccccaggagagacagccagcatcacctgctctggagatcaattgggggaaaattatgcttgctggtatcagcagaagccaggccagtcccctgtgttggtcatctatcaagatagtaagcggccctcagggatccctgagcgattctctggctccaactctgggaacacagccactctgaccatcagcgggacccaggctctggatgaggctgactattactgtcaggcgtgggacaacagtattgtggtattcggcggagggaccaagctgaccgtccta

SEQ ID NO: 247 - DNA, 327 bp, Artificial Sequence
  Description of Artificial Sequence: Synthetic polynucleotide
cagtctgtgctgactcagccaccctcggtgtcagtggcccccgggcagacggccagtattacctgtgggggagacaacattggaagtaaaagtgtgcactggtaccagcagaagccaggccaggcccctgtgctggtcgtctatgataatagcgaccggccctcagggatccctgagcgattctctggctccaactctgggaccacggccaccctgaccatcagcagggtcgaagccggggatgaggccgactattactgtcaggtgtgggatagtagtagtgatcatcctgtggtattcggcggagggaccaaggtcaccgtccta

SEQ ID NO: 248 - DNA, 1341 bp, Artificial Sequence
  Description of Artificial Sequence: Synthetic polynucleotide
gatgtgcagcttcaggagtctggacccggacttgttaaaccaagtcagtctctgtccctgacctgtaccgtcaccggcaacagcatcacaagcgattacgcatggaactggatcaggcagttccctggaaatcgactcgaatggatgggctacatttcatactccggttcaaccacttactctccatccttgaaatctaggttcagcatcacccgtgatacctcaaagaaccaattttttctgcaactgaatagcgtaactccagaggacacagccacatatttctgcgccactgggtattactatggctcaggtttctggggtcagggcactctcgtcaccgtcagcagcgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcaccgacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 249 - DNA, 1341 bp, Artificial Sequence
  Description of Artificial Sequence: Synthetic polynucleotide
caggtccaactgcaagagagcggaccgggcctggtaaagccatccgacacattgtccctgacgtgtgcggtaagtggaaactctatcactagcgactatgcgtggaattggataagacaaccgccgggcaaggggctggaatggataggatatatcagctattccggttctacgacatacaatccttccctgaaaagcagagtcactatgtcacgcgacacgtccaagaatcagttctcattgaaattgtcatccgtaacggccgttgacactgcggtttattattgcgcaaccggatattactacggctctggtttttggggacagggaacacttgttactgttagttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcagatggcagcaggggaacgtcttctcatgctccgtgatgcatgaggctctgcacaaccactacacgcagaagagcctctccctgtctccgggtaaa

SEQ ID NO: 250 - DNA, 1356 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttactactggagctggatccggcagcccccagggaagggactggagtggattggatatatctattacagtgggagcaccaactacaacccctccctcaagagtcgagtcaccatatcagtagacacgtccaagaaccagttctccctgaagctgagctctgtgaccgctgcggacacggccgtgtattactgtgcggggactacgatttttggagtggttacccccaacttctactacggtatggacgtctggggccaagggaccacggtcaccgtctcctcagcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacttgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcagatggcaggaggggaatgtcttctcatgctccgtgatgcatgaggctctgcacaaccactacacacagaagagcctctccctgtctctgggtaaa

SEQ ID NO: 251 - DNA, 1350 bp, Artificial Sequence
  Description of Artificial Sequence: Synthetic polynucleotide
gaggtgcagctggtggagtctgggggaggcgtggtccagcctgggaggtccctgagactctcctgtgtagcctctggattcaccttcagtagttatgacatacactgggtccgccaggctccaggcaaggggctggagtgggtggcaattatttcatatgatggaagtaaaaaagactatacagactccgtgaagggccgattcaccatctccagagacaattccaagaacacgctgtatctgcaaatggacagcctgagagttgaggactcggctgtgtattcctgtgcgagagaaagtggctggtcccactactactattacggtatggacgtctggggccaagggacaatggtcaccgtctcttcagcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacttgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcagatggcaggaggggaatgtcttctcatgctccgtgatgcatgaggctctgcacaaccactacacacagaagagcctctccctgtctctgggtaaa

SEQ ID NO: 252 - DNA, 1338 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttactattggagctggctccggcagcccgccgggtcgggactggagtggattgggcgtttatatgtcagtgggttcaccaactacaacccctccctcaagagtcgagtcaccttgtcactagacccgtccaggaaccagttgtccctgaaactgagttctgtgaccgccgcggacacggccgtatattattgtgcgggagatagtgggaactactggggttggttcgacccctggggccagggaaccctggtcaccgtctcctcagcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacttgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcagatggcaggaggggaatgtcttctcatgctccgtgatgcatgaggctctgcacaaccactacacacagaagagcctctccctgtctctgggtaaa

SEQ ID NO: 253 - DNA, 1353 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagttactatggcatgcactgggtccgccaggctccaggcaaggggctggagtgggtggcatttatatcatatgatggaagtaataaatactatgcagactccgtgaagggccgattcaccatctccagagacaattccaagaacacgctgtatctgcaaatgaacagcctgagagctgaggacacggctgtgtattactgtgcccacctcccttatagtgggagctactgggcctttgactactggggccagggaacccaggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagccgccgggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcagatggcagcaggggaacgtcttctcatgctccgtgatgcatgaggctctgcacaaccactacacgcagaagagcctctccctgtctccgggtaaa

SEQ ID NO: 254 - DNA, 1365 bp, Artificial Sequence
  Description of Artificial Sequence: Synthetic polynucleotide
caggtgcagctggtggagtctgggggaggcttggtacagcctggggggtccctgagactctcctgtgcagcctctggattcacctttagtcattatgccatgagctgggtccgccaggctccagggaaggggctggagtgggtctcaactattggtggtagtggtggtagcacatactacgcagactccgtgaagggccggttcaccatctccagagacaattccaagaacacgctgtatctgcaaatgaacagcctgagagccgaggacacggccgtatattactgtgcgaaacctcatattgtaatggtgactgctcttctctacgacggtatggacgtctggggccaagggacaatggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagccgccgggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcagatggcagcaggggaacgtcttctcatgctccgtgatgcatgaggctctgcacaaccactacacgcagaagagcctctccctgtctccgggtaaa

SEQ ID NO: 255 - DNA, 654 bp, Artificial Sequence
  Description of Artificial Sequence: Synthetic polynucleotide
gacattgtgctgacacagagtccagcatccttggcagtatctttggggcagcgggcaacaatttcatgccgtgcatctgaaagtgtggagtattttggaacttctcttatgcactggtatcgccagaagcctgggcagcctcccaaactccttatatatgccgcttccaacgtggagtccggagtaccagcacgcttttccggctctgggtccggcacagacttttccctcaatatccaacctgttgaagaagacgatttttccatgtatttttgccaacagacacgcaaggttccatatacattcggcggcggcactaaacttgagatcaaacgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 256 - DNA, 654 bp, Artificial Sequence
  Description of Artificial Sequence: Synthetic polynucleotide
gacatagtcttgactcagagcccggattcccttgctgtgtctctgggagaacgagctacgatcaactgcaaggcaagtgaatccgtagaatacttcgggacatcattgatgcattggtatcaacagaaaccggggcaaccgcccaaattgctgatatatgcggctagtaatagagaatcaggagtaccggataggtttagtggttcaggatcaggtacagatttcaccctgacaataagtagcttgcaagccgaagacgtagcagtgtattactgccaacaaacccgaaaggtgccatatacgtttggacagggtacaaagttggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 257 - DNA, 642 bp, Artificial Sequence
  Description of Artificial Sequence: Synthetic polynucleotide
gacatccagatgacccagtctccttccttcctgtctgcatctgtaggagacagagtcaccatcacttgccgggccagtcagggcattagcagttatttagcctggtatcagcaaaaaccagggaaagcccctaagttcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctctcactttcggcggagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 258 - DNA, 642 bp, Artificial Sequence
  Description of Artificial Sequence: Synthetic polynucleotide
gacatcgtgatgacccagtctccatcctccctgtctgcatctgtaggagacagagtcaccatcacttgccgggcgagtcaggacattagcaattatttagcctggtatcagcagaaaccagggaaagttcctaagttcctgatctatgctgcatccactttgcactctggggtcccatctcggttcagtggcagtggatctgggacagatttcactctcaccatcagcagcctgcagcctgaagatgttgcaacttattactgtcaaaagtataacagtgccccgtacacttttggccaagggacacgactggagattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 259 - DNA, 636 bp, Artificial Sequence
  Description of Artificial Sequence: Synthetic polynucleotide
tcctatgagctgactcagccaccctcagtgtccgtgtccccaggagagacagccagcatcacctgctctggagatcaattgggggaaaattatgcttgctggtatcagcagaagccaggccagtcccctgtgttggtcatctatcaagatagtaagcggccctcagggatccctgagcgattctctggctccaactctgggaacacagccactctgaccatcagcgggacccaggctctggatgaggctgactattactgtcaggcgtgggacaacagtattgtggtattcggcggagggaccaagctgaccgtcctaggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 260 - DNA, 645 bp, Artificial Sequence
  Description of Artificial Sequence: Synthetic polynucleotide
cagtctgtgctgactcagccaccctcggtgtcagtggcccccgggcagacggccagtattacctgtgggggagacaacattggaagtaaaagtgtgcactggtaccagcagaagccaggccaggcccctgtgctggtcgtctatgataatagcgaccggccctcagggatccctgagcgattctctggctccaactctgggaccacggccaccctgaccatcagcagggtcgaagccggggatgaggccgactattactgtcaggtgtgggatagtagtagtgatcatcctgtggtattcggcggagggaccaaggtcaccgtcctaggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 261 - DNA, 642 bp, Artificial Sequence
  Description of Artificial Sequence: Synthetic polynucleotide
tcttctgagctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatgtggtattcggcggagggaccaagctgaccgtcctaggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 262 - protein, 248 aa, Artificial Sequence
  Description of Artificial Sequence: Synthetic polypeptide
QVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTIQSVQAEDVSVYFCQQTRKVPYTFGQGTKLEIK

SEQ ID NO: 263 - protein, 248 aa, Artificial Sequence
  Description of Artificial Sequence: Synthetic polypeptide
QVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTISSLQAEDVAVYYCQQTRKVPYTFGQGTKLEIK

SEQ ID NO: 264 - protein, 248 aa, Artificial Sequence
  Description of Artificial Sequence: Synthetic polypeptide
QVQLQESGPGLVKPSDTLSLTCAVSGNSITSDYAWNWIRQFPGKGLEWIGYISYSGSTTYNPSLKSRVTISRDTSKNQFSLKLSSVTPVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIK

SEQ ID NO: 265 - protein, 248 aa, Artificial Sequence
  Description of Artificial Sequence: Synthetic polypeptide
QVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIK

SEQ ID NO: 266 - protein, 248 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTIQSVQAEDVSVYFCQQTRKVPYTFGQGTKLEIKGGSEGKSSGSGSESKSTGGSQVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSS

SEQ ID NO: 267 - protein, 248 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTISSLQAEDVAVYYCQQTRKVPYTFGQGTKLEIKGGSEGKSSGSGSESKSTGGSQVQLQESGPGLVKPSDTLSLTCAVSGNSITSDYAWNWIRQFPGKGLEWIGYISYSGSTTYNPSLKSRVTISRDTSKNQFSLKLSSVTPVDTAVYYCATGYYYGSGFWGQGTLVTVSS

SEQ ID NO: 268 - protein, 248 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTISSLQAEDVAVYYCQQTRKVPYTFGQGTKLEIKGGSEGKSSGSGSESKSTGGSQVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSS

SEQ ID NO: 269 - protein, 248 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIKGGSEGKSSGSGSESKSTGGSQVQLQESGPGLVKPSDTLSLTCAVSGNSITSDYAWNWIRQFPGKGLEWIGYISYSGSTTYNPSLKSRVTISRDTSKNQFSLKLSSVTPVDTAVYYCATGYYYGSGFWGQGTLVTVSS

SEQ ID NO: 270 - protein, 248 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIKGGSEGKSSGSGSESKSTGGSQVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSS

SEQ ID NO: 271 - protein, 248 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTIQSVQAEDVSVYFCQQTRKVPYTFGQGTKLEIKGGSEGKSSGSGSESKSTGGSQVQLQESGPGLVKPSDTLSLTCAVSGNSITSDYAWNWIRQFPGKGLEWIGYISYSGSTTYNPSLKSRVTISRDTSKNQFSLKLSSVTPVDTAVYYCATGYYYGSGFWGQGTLVTVSS

SEQ ID NO: 272 - protein, 248 aa, Artificial Sequence
  Description of Artificial Sequence: Synthetic polypeptide
QVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIK

SEQ ID NO: 273 - protein, 248 aa, Artificial Sequence
  Description of Artificial Sequence: Synthetic polypeptide
QVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTIQSVQAEDVSVYFCQQTRKVPYTFGQGTKLEIK

SEQ ID NO: 274 - protein, 248 aa, Artificial Sequence
  Description of Artificial Sequence: Synthetic polypeptide
QVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTISSLQAEDVAVYYCQQTRKVPYTFGQGTKLEIK

SEQ ID NO: 275 - protein, 248 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTIQSVQAEDVSVYFCQQTRKVPYTFGQGTKLEIKGGSEGKSSGSGSESKSTGGSQVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSS

SEQ ID NO: 276 - protein, 248 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTISSLQAEDVAVYYCQQTRKVPYTFGQGTKLEIKGGSEGKSSGSGSESKSTGGSQVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSS

SEQ ID NO: 277 - protein, 248 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIKGGSEGKSSGSGSESKSTGGSQVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSS

SEQ ID NO: 278 - protein, 251 aa, Artificial Sequence
  Description of Artificial Sequence: Synthetic polypeptide
EVQLVESGGGLVQPGGSLRLSCAASGFTFSSYWMTWVRQAPGKGLEWVANIKQDGSERYYVDSVKGRFTISRDNAKNSLYLQMNSLRAEDTAVYYCARDQNYDILTGHYGMDVWGQGTTVTVSSGGSEGKSSGSGSESKSTGGSEIVLTQSPSFLSASVGDRVTITCRASQGISSYLSWYQQKPGKAPKLLIYATSTLQSGVPSRFSGSGSGTEFTLTISSLQPEDFATYYCQQLNSYPRTFGQGTKVEIK

SEQ ID NO: 279 - protein, 251 aa, Artificial Sequence
  Description of Artificial Sequence: Synthetic polypeptide
EIVLTQSPSFLSASVGDRVTITCRASQGISSYLSWYQQKPGKAPKLLIYATSTLQSGVPSRFSGSGSGTEFTLTISSLQPEDFATYYCQQLNSYPRTFGQGTKVEIKGGSEGKSSGSGSESKSTGGSEVQLVESGGGLVQPGGSLRLSCAASGFTFSSYWMTWVRQAPGKGLEWVANIKQDGSERYYVDSVKGRFTISRDNAKNSLYLQMNSLRAEDTAVYYCARDQNYDILTGHYGMDVWGQGTTVTVSS

SEQ ID NO: 280 - protein, 248 aa, Artificial Sequence
  Description of Artificial Sequence: Synthetic polypeptide
QVQLQESGPGLVKPSQTLSLTCTVSGNSITSDYAWNWIRQFPGKRLEWIGYISYSGSTTYNPSLKSRVTISRDTSKNQFSLKLSSVTAADTAVYYCATGYYYGSGFWGQGTLVTVSSGGSEGKSSGSGSESKSTGGSEIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIK

SEQ ID NO: 281 - protein, 248 aa, Artificial Sequence
  Description of Artificial Sequence: Synthetic polypeptide
EIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIKGGSEGKSSGSGSESKSTGGSQVQLQESGPGLVKPSQTLSLTCTVSGNSITSDYAWNWIRQFPGKRLEWIGYISYSGSTTYNPSLKSRVTISRDTSKNQFSLKLSSVTAADTAVYYCATGYYYGSGFWGQGTLVTVSS

SEQ ID NO: 282 - protein, 248 aa, Artificial Sequence
  Description of Artificial Sequence: Synthetic polypeptide
QVQLQESGPGLVKPSQTLSLTCTVSGNSITSDYAWNWIRQFPGKGLEWIGYISYSGSTTYNPSLKSRVTISRDTSKNQFSLKLSSVTAADTAVYYCATGYYYGSGFWGQGTLVTVSSGGSEGKSSGSGSESKSTGGSDIVLTQSPDSLAVSLGERATINCRASESVEYFGTSLMHWYQQKPGQPPKLLIYAASNVESGVPDRFSGSGSGTDFTLTISSLQAEDVAVYFCQQTRKVPYTFGGGTKVEIK

SEQ ID NO: 283 - protein, 248 aa, Artificial Sequence
  Description of Artificial Sequence: Synthetic polypeptide
DIVLTQSPDSLAVSLGERATINCRASESVEYFGTSLMHWYQQKPGQPPKLLIYAASNVESGVPDRFSGSGSGTDFTLTISSLQAEDVAVYFCQQTRKVPYTFGGGTKVEIKGGSEGKSSGSGSESKSTGGSQVQLQESGPGLVKPSQTLSLTCTVSGNSITSDYAWNWIRQFPGKGLEWIGYISYSGSTTYNPSLKSRVTISRDTSKNQFSLKLSSVTAADTAVYYCATGYYYGSGFWGQGTLVTVSS

SEQ ID NO: 284 - protein, 248 aa, Artificial Sequence
  Description of Artificial Sequence: Synthetic polypeptide
QVQLQESGPGLVKPSQTLSLTCTVSGNSITSDYAWNWIRQPPGKGLEWIGYISYSGSTTYNPSLKSRVTISRDTSKNQFSLKLSSVTAADTAVYYCATGYYYGSGFWGQGTLVTVSSGGSEGKSSGSGSESKSTGGSEIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIK

SEQ ID NO: 285 - protein, 248 aa, Artificial Sequence
  Description of Artificial Sequence: Synthetic polypeptide
EIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIKGGSEGKSSGSGSESKSTGGSQVQLQESGPGLVKPSQTLSLTCTVSGNSITSDYAWNWIRQPPGKGLEWIGYISYSGSTTYNPSLKSRVTISRDTSKNQFSLKLSSVTAADTAVYYCATGYYYGSGFWGQGTLVTVSS

SEQ ID NO: 286 - protein, 248 aa, Artificial Sequence
  Description of Artificial Sequence: Synthetic polypeptide
QVQLQESGPGLVKPSQTLSLTCTVSGNSITSDYAWNWIRQFPGKGLEWIGYISYSGSTTYNPSLKSRVTISRDTSKNQFSLKLSSVTAADTAVYYCATGYYYGSGFWGQGTLVTVSSGGSEGKSSGSGSESKSTGGSEIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIK

SEQ ID NO: 287 - protein, 248 aa, Artificial Sequence
  Description of Artificial Sequence: Synthetic polypeptide
EIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIKGGSEGKSSGSGSESKSTGGSQVQLQESGPGLVKPSQTLSLTCTVSGNSITSDYAWNWIRQFPGKGLEWIGYISYSGSTTYNPSLKSRVTISRDTSKNQFSLKLSSVTAADTAVYYCATGYYYGSGFWGQGTLVTVSS

SEQ ID NO: 288 - protein, 249 aa, Artificial Sequence
  Description of Artificial Sequence: Synthetic polypeptide
QVQLVESGGGVVQPGRSLRLSCAASGFTFSYYGMHWVRQAPGKGLEWVAFISYDGSNKYYADSVKGRFTISRDNSKNTLYLQMNSLRAEDTAVYYCAHLPYSGSYWAFDYWGQGTQVTVSSGGSEGKSSGSGSESKSTGGSQSVLTQPPSVSVAPGQTASITCGGDNIGSKSVHWYQQKPGQAPVLVVYDNSDRPSGIPERFSGSNSGTTATLTISRVEAGDEADYYCQVWDSSSDHPVVFGGGTKVTV

SEQ ID NO: 289 - protein, 249 aa, Artificial Sequence
  Description of Artificial Sequence: Synthetic polypeptide
QSVLTQPPSVSVAPGQTASITCGGDNIGSKSVHWYQQKPGQAPVLVVYDNSDRPSGIPERFSGSNSGTTATLTISRVEAGDEADYYCQVWDSSSDHPVVFGGGTKVTVGGSEGKSSGSGSESKSTGGSQVQLVESGGGVVQPGRSLRLSCAASGFTFSYYGMHWVRQAPGKGLEWVAFISYDGSNKYYADSVKGRFTISRDNSKNTLYLQMNSLRAEDTAVYYCAHLPYSGSYWAFDYWGQGTQVTVSS

SEQ ID NO: 290 - protein, 253 aa, Artificial Sequence
  Description of Artificial Sequence: Synthetic polypeptide
QVQLVESGGGLVQPGGSLRLSCAASGFTFSHYAMSWVRQAPGKGLEWVSTIGGSGGSTYYADSVKGRFTISRDNSKNTLYLQMNSLRAEDTAVYYCAKPHIVMVTALLYDGMDVWGQGTMVTVSSGGSEGKSSGSGSESKSTGGSSSELTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVL

SEQ ID NO: 291 - protein, 253 aa, Artificial Sequence
  Description of Artificial Sequence: Synthetic polypeptide
SSELTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVLGGSEGKSSGSGSESKSTGGSQVQLVESGGGLVQPGGSLRLSCAASGFTFSHYAMSWVRQAPGKGLEWVSTIGGSGGSTYYADSVKGRFTISRDNSKNTLYLQMNSLRAEDTAVYYCAKPHIVMVTALLYDGMDVWGQGTMVTVSS

SEQ ID NO: 292 - protein, 9 aa, Artificial Sequence
  Description of Artificial Sequence: Synthetic peptide
GWGSIEPEE

SEQ ID NO: 293 - protein, 231 aa, Artificial Sequence
  Description of Artificial Sequence: Synthetic polypeptide
EPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 294 - DNA, 729 bp, Artificial Sequence
  Description of Artificial Sequence: Synthetic polynucleotide
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcggcggatctgagggaaagtccagcggctccggcagcgaaagcaagtccaccggcggaagcgacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaag

SEQ ID NO: 295 - DNA, 729 bp, Artificial Sequence
  Description of Artificial Sequence: Synthetic polynucleotide
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaagggcggatctgagggaaagtccagcggctccggcagcgaaagcaagtccaccggcggaagcgaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagc

SEQ ID NO: 296 - DNA, 729 bp, Artificial Sequence
  Description of Artificial Sequence: Synthetic polynucleotide
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcggcggatctgagggaaagtccagcggctccggcagcgaaagcaagtccaccggcggaagcgacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaag

SEQ ID NO: 297 - DNA, 729 bp, Artificial Sequence
  Description of Artificial Sequence: Synthetic polynucleotide
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaagggcggatctgagggaaagtccagcggctccggcagcgaaagcaagtccaccggcggaagcgaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagc

SEQ ID NO: 298 - DNA, 729 bp, Artificial Sequence
  Description of Artificial Sequence: Synthetic polynucleotide
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcggcggatctgagggaaagtccagcggctccggcagcgaaagcaagtccaccggcggaagcgacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaag

SEQ ID NO: 299 - DNA, 729 bp, Artificial Sequence
  Description of Artificial Sequence: Synthetic polynucleotide
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaagggcggatctgagggaaagtccagcggctccggcagcgaaagcaagtccaccggcggaagcgaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagc

SEQ ID NO: 300 - DNA, 729 bp, Artificial Sequence
  Description of Artificial Sequence: Synthetic polynucleotide
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcggcggatctgagggaaagtccagcggctccggcagcgaaagcaagtccaccggcggaagcgacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaag

SEQ ID NO: 301 - DNA, 729 bp, Artificial Sequence
  Description of Artificial Sequence: Synthetic polynucleotide
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaagggcggatctgagggaaagtccagcggctccggcagcgaaagcaagtccaccggcggaagcgaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagc

SEQ ID NO: 302 - DNA, 729 bp, Artificial Sequence
  Description of Artificial Sequence: Synthetic polynucleotide
gaggtgcaactggtggagtctgggggaggcctggtcaagcctggggggtccctgagactctcctgtgcagcctctggattcaccttcagtagatataacatgaactgggtccgccaggctccagggaaggggctggagtgggtctcatccattagtactagtagtaattacatatactacgcagactcagtgaagggccgattcaccttctccagagacaacgccaagaactcactggatctgcaaatgagcggcctgagagccgaggacacggctatttattactgtacgagaggctgggggccttttgactactggggccagggaaccctggtcaccgtctcctcaggcggatctgagggaaagtccagcggctccggcagcgaaagcaagtccaccggcggaagcgacatcttgctgactcagtctccaggcatcctgtctgtgagtccaggagaaagagtcagtttctcctgcagggccagacagagcattggcacagccatacactggtatcagcaaagaacaaatggttctccaaggcttctcataaagtatgcttctgagtctatctctgggatcccttccaggtttagcggcagtggatcagggacagattttactcttaccatcaacagtgtggagtctgaagatattgcagattattactgtcaacaaagtgggagctggccgtacacgttcggaggggggaccaagctggaaataaaa

SEQ ID NO: 303 - DNA, 729 bp, Artificial Sequence
  Description of Artificial Sequence: Synthetic polynucleotide
gacatcttgctgactcagtctccaggcatcctgtctgtgagtccaggagaaagagtcagtttctcctgcagggccagacagagcattggcacagccatacactggtatcagcaaagaacaaatggttctccaaggcttctcataaagtatgcttctgagtctatctctgggatcccttccaggtttagcggcagtggatcagggacagattttactcttaccatcaacagtgtggagtctgaagatattgcagattattactgtcaacaaagtgggagctggccgtacacgttcggaggggggaccaagctggaaataaaaggcggatctgagggaaagtccagcggctccggcagcgaaagcaagtccaccggcggaagcgaggtgcaactggtggagtctgggggaggcctggtcaagcctggggggtccctgagactctcctgtgcagcctctggattcaccttcagtagatataacatgaactgggtccgccaggctccagggaaggggctggagtgggtctcatccattagtactagtagtaattacatatactacgcagactcagtgaagggccgattcaccttctccagagacaacgccaagaactcactggatctgcaaatgagcggcctgagagccgaggacacggctatttattactgtacgagaggctgggggccttttgactactggggccagggaaccctggtcaccgtctcctca

SEQ ID NO: 304 - DNA, 1425 bp, Artificial Sequence
  Description of Artificial Sequence: Synthetic polynucleotide
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcggcggatctgagggaaagtccagcggctccggcagcgaaagcaagtccaccggcggaagcgacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaaggagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 305 - DNA, 1425 bp, Artificial Sequence
  Description of Artificial Sequence: Synthetic polynucleotide
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaagggcggatctgagggaaagtccagcggctccggcagcgaaagcaagtccaccggcggaagcgaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 306 - DNA, 1425 bp, Artificial Sequence
  Description of Artificial Sequence: Synthetic polynucleotide
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcggcggatctgagggaaagtccagcggctccggcagcgaaagcaagtccaccggcggaagcgacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaaggagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 307 - DNA, 1425 bp, Artificial Sequence
  Description of Artificial Sequence: Synthetic polynucleotide
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaagggcggatctgagggaaagtccagcggctccggcagcgaaagcaagtccaccggcggaagcgaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 308 - DNA, 1425 bp, Artificial Sequence
  Description of Artificial Sequence: Synthetic polynucleotide
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcggcggatctgagggaaagtccagcggctccggcagcgaaagcaagtccaccggcggaagcgacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaaggagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 309 - DNA, 1425 bp, Artificial Sequence
  Description of Artificial Sequence: Synthetic polynucleotide
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaagggcggatctgagggaaagtccagcggctccggcagcgaaagcaagtccaccggcggaagcgaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 310 - DNA, 1425 bp, Artificial Sequence
  Description of Artificial Sequence: Synthetic polynucleotide
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcggcggatctgagggaaagtccagcggctccggcagcgaaagcaagtccaccggcggaagcgacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaaggagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 311 - DNA, 1425 bp, Artificial Sequence
  Description of Artificial Sequence: Synthetic polynucleotide
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaagggcggatctgagggaaagtccagcggctccggcagcgaaagcaagtccaccggcggaagcgaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 312 - DNA, 1425 bp, Artificial Sequence
  Description of Artificial Sequence: Synthetic polynucleotide
gaggtgcaactggtggagtctgggggaggcctggtcaagcctggggggtccctgagactctcctgtgcagcctctggattcaccttcagtagatataacatgaactgggtccgccaggctccagggaaggggctggagtgggtctcatccattagtactagtagtaattacatatactacgcagactcagtgaagggccgattcaccttctccagagacaacgccaagaactcactggatctgcaaatgagcggcctgagagccgaggacacggctatttattactgtacgagaggctgggggccttttgactactggggccagggaaccctggtcaccgtctcctcaggcggatctgagggaaagtccagcggctccggcagcgaaagcaagtccaccggcggaagcgacatcttgctgactcagtctccaggcatcctgtctgtgagtccaggagaaagagtcagtttctcctgcagggccagacagagcattggcacagccatacactggtatcagcaaagaacaaatggttctccaaggcttctcataaagtatgcttctgagtctatctctgggatcccttccaggtttagcggcagtggatcagggacagattttactcttaccatcaacagtgtggagtctgaagatattgcagattattactgtcaacaaagtgggagctggccgtacacgttcggaggggggaccaagctggaaataaaagagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 313 - DNA, 1425 bp, Artificial Sequence
  Description of Artificial Sequence: Synthetic polynucleotide
gacatcttgctgactcagtctccaggcatcctgtctgtgagtccaggagaaagagtcagtttctcctgcagggccagacagagcattggcacagccatacactggtatcagcaaagaacaaatggttctccaaggcttctcataaagtatgcttctgagtctatctctgggatcccttccaggtttagcggcagtggatcagggacagattttactcttaccatcaacagtgtggagtctgaagatattgcagattattactgtcaacaaagtgggagctggccgtacacgttcggaggggggaccaagctggaaataaaaggcggatctgagggaaagtccagcggctccggcagcgaaagcaagtccaccggcggaagcgaggtgcaactggtggagtctgggggaggcctggtcaagcctggggggtccctgagactctcctgtgcagcctctggattcaccttcagtagatataacatgaactgggtccgccaggctccagggaaggggctggagtgggtctcatccattagtactagtagtaattacatatactacgcagactcagtgaagggccgattcaccttctccagagacaacgccaagaactcactggatctgcaaatgagcggcctgagagccgaggacacggctatttattactgtacgagaggctgggggccttttgactactggggccagggaaccctggtcaccgtctcctcagagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 314 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 315 - DNA, 1338 bp, Artificial Sequence
  Description of Artificial Sequence: Synthetic polynucleotide
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 316 - DNA, 642 bp, Artificial Sequence
  Description of Artificial Sequence: Synthetic polynucleotide
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 317 - DNA, 642 bp, Artificial Sequence
  Description of Artificial Sequence: Synthetic polynucleotide
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 318 - DNA, 642 bp, Artificial Sequence
  Description of Artificial Sequence: Synthetic polynucleotide
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 319 - DNA, 642 bp, Artificial Sequence
  Description of Artificial Sequence: Synthetic polynucleotide
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 320 - DNA, 642 bp, Artificial Sequence
  Description of Artificial Sequence: Synthetic polynucleotide
gacatcttgctgactcagtctccaggcatcctgtctgtgagtccaggagaaagagtcagtttctcctgcagggccagacagagcattggcacagccatacactggtatcagcaaagaacaaatggttctccaaggcttctcataaagtatgcttctgagtctatctctgggatcccttccaggtttagcggcagtggatcagggacagattttactcttaccatcaacagtgtggagtctgaagatattgcagattattactgtcaacaaagtgggagctggccgtacacgttcggaggggggaccaagctggaaataaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 321 - protein, 231 aa, Artificial Sequence
  Description of Artificial Sequence: Synthetic polypeptide
EPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 322 - protein, 479 aa, Artificial Sequence
  Description of Artificial Sequence: Synthetic polypeptide
EIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIKGGSEGKSSGSGSESKSTGGSQVQLQESGPGLVKPSQTLSLTCTVSGNSITSDYAWNWIRQFPGKRLEWIGYISYSGSTTYNPSLKSRVTISRDTSKNQFSLKLSSVTAADTAVYYCATGYYYGSGFWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 323 - protein, 482 aa, Artificial Sequence
  Description of Artificial Sequence: Synthetic polypeptide
EIVLTQSPSFLSASVGDRVTITCRASQGISSYLSWYQQKPGKAPKLLIYATSTLQSGVPSRFSGSGSGTEFTLTISSLQPEDFATYYCQQLNSYPRTFGQGTKVEIKGGSEGKSSGSGSESKSTGGSEVQLVESGGGLVQPGGSLRLSCAASGFTFSSYWMTWVRQAPGKGLEWVANIKQDGSERYYVDSVKGRFTISRDNAKNSLYLQMNSLRAEDTAVYYCARDQNYDILTGHYGMDVWGQGTTVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 324 - protein, 481 aa, Artificial Sequence
  Description of Artificial Sequence: Synthetic polypeptide
QSVLTQPPSVSVAPGQTASITCGGDNIGSKSVHWYQQKPGQAPVLVVYDNSDRPSGIPERFSGSNSGTTATLTISRVEAGDEADYYCQVWDSSSDHPVVFGGGTKVTVLGGSEGKSSGSGSESKSTGGSQVQLVESGGGVVQPGRSLRLSCAASGFTFSYYGMHWVRQAPGKGLEWVAFISYDGSNKYYADSVKGRFTISRDNSKNTLYLQMNSLRAEDTAVYYCAHLPYSGSYWAFDYWGQGTQVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 325 - protein, 484 aa, Artificial Sequence
  Description of Artificial Sequence: Synthetic polypeptide
SSELTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVLGGSEGKSSGSGSESKSTGGSQVQLVESGGGLVQPGGSLRLSCAASGFTFSHYAMSWVRQAPGKGLEWVSTIGGSGGSTYYADSVKGRFTISRDNSKNTLYLQMNSLRAEDTAVYYCAKPHIVMVTALLYDGMDVWGQGTMVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 326 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 327 - protein, 454 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 328 - protein, 448 aa, Artificial Sequence
  Description of Artificial Sequence: Synthetic polypeptide
QVQLQESGPGLVKPSETLSLTCTVSGGSISSYYWSWLRQPAGSGLEWIGRLYVSGFTNYNPSLKSRVTLSLDPSRNQLSLKLSSVTAADTAVYYCAGDSGNYWGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 329 - protein, 452 aa, Artificial Sequence
  Description of Artificial Sequence: Synthetic polypeptide
EVQLVESGGGVVQPGRSLRLSCVASGFTFSSYDIHWVRQAPGKGLEWVAIISYDGSKKDYTDSVKGRFTISRDNSKNTLYLQMDSLRVEDSAVYSCARESGWSHYYYYGMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 330 - protein, 455 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 331 - protein, 475 aa, Artificial Sequence
  Description of Artificial Sequence: Synthetic polypeptide
DIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 332 - DNA, 1437 bp, Artificial Sequence
  Description of Artificial Sequence: Synthetic polynucleotide
gagattgttctcacccaatccccagctactctctctctttcacccggtgagcgggcaaccctctcctgtagagccagcgagagcgtggagtattttggcacatccctgatgcactggtatcagcaaaaaccaggacaaccccccagactcctcatatatgccgcctcaaatgtcgagagtgggatacctgcacggttttcaggaagcggcagcggtactgacttcacattgactatatcctctgtagagccagaggattttgcagtctacttctgccagcaaactaggaaggttccatatacttttgggggcggtacaaaagttgagataaagggcggctccgagggcaagagcagcggcagcggcagcgagagcaagagcaccggcggcagccaagtacagctccaggagtcaggacctgggctcgtcaaaccatctcagacattgtccctgacatgcacagtttccggcaacagtattacttccgactatgcttggaattggatcaggcaattcccaggaaagcggctcgagtggataggttatatttcttactctggatctactacctacaatcccagtttgaagtctcgcgtgacaattagccgggacacatcaaaaaatcaattctcacttaaacttagttctgtaaccgctgccgatacagccgtgtactactgcgccactggttattattatggaagcggattttgggggcaaggaactttggtgaccgtctcttccgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 333 - DNA, 1356 bp, Artificial Sequence
  Description of Artificial Sequence: Synthetic polynucleotide
gaggtacaacttgtcgaaagtggcggtggagtcgtccagcctgggcgatcacttcgcctctcctgtgtagcctctggtttcactttctcatcttacgacatacactgggtccgccaggcacctggtaaggggctggagtgggttgccatcattagttacgatggctccaaaaaagattacaccgatagcgtaaagggcagatttaccatttccagggataattcaaagaacaccctgtatctgcaaatggacagcctccgcgtcgaagactctgcagtttatagctgtgccagggagtcaggctggtcccattattactattatggtatggacgtttggggccagggaaccatggtcactgttagttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 334 - DNA, 1443 bp, Artificial Sequence
  Description of Artificial Sequence: Synthetic polynucleotide
cagagcgtacttacccagcctcccagcgtgtctgtagccccaggacagacagccagtattacatgcggtggtgacaatataggttccaaatccgtgcattggtaccagcagaagccagggcaagctcccgtgctcgtggtatatgataattccgaccgcccttccggcattcccgaacggtttagtggttcaaattcaggcaccacagcaactctgaccataagcagagtcgaagctggagacgaagccgactactactgtcaggtatgggactctagtagtgaccaccctgtcgtcttcggtgggggaaccaaagtgaccgttctgggcggctccgagggcaagagcagcggcagcggcagcgagagcaagagcaccggcggcagccaggtccagctcgtagaaagtgggggcggcgtagttcagccaggcaggagtctccggctgagttgtgcagccagcggctttactttttcctactatggaatgcactgggtacgtcaggcacccggcaaaggtttggagtgggtcgcattcatttcttatgatggatcaaataagtattatgccgatagtgtaaagggcagatttacaataagtcgagacaactcaaagaacactctctacctccaaatgaatagtcttcgggcagaggatactgcagtgtactattgtgctcatcttccttattccggttcttactgggcattcgattattgggggcaagggacacaagttaccgtgtctagcgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 335 - DNA, 1362 bp, Artificial Sequence
  Description of Artificial Sequence: Synthetic polynucleotide
caggttcaacttcaagaatccgggccaggtctggtcaagccttcagagactttgtcccttacttgcacagtgagcggtggctctatctcaagttactactggtcatggatacggcagcccccaggaaaggggcttgagtggattgggtacatttattactcagggtcaacaaactacaatccctccctcaaatcccgagtgacaattagtgtcgatacatctaaaaaccagttttccctgaaattgagctcagtcaccgcagctgatactgcagtctattattgtgctggcacaacaatcttcggggtagtaactccaaacttctactacgggatggacgtgtgggggcaaggaacaaccgtaacagtaagtagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 336 - DNA, 1344 bp, Artificial Sequence
  Description of Artificial Sequence: Synthetic polynucleotide
caagtacaacttcaagagtctggccctgggcttgttaagccctcagagaccttgtcactgacctgtaccgtatcaggcgggtcaatttcatcttactactggagttggcttcgtcagcctgccggatctggactggagtggataggtagactgtatgtttccggctttacaaattacaacccatctttgaaaagccgtgtgactctcagcctcgacccttctcggaatcaactttcacttaaattgtcttctgttacagctgccgacactgcagtatattattgtgcaggggactcaggcaactattggggatggtttgatccttgggggcaggggaccctggtaaccgtgagttctgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 337 - DNA, 1356 bp, Artificial Sequence; identical to SEQ ID NO: 333
  Description of Artificial Sequence: Synthetic polynucleotide

SEQ ID NO: 338 - DNA, 1452 bp, Artificial Sequence
  Description of Artificial Sequence: Synthetic polynucleotide
agcagcgaattgacccaaccaccttccgtcagcgtcgcaccagggcaaaccgcccgcatcacatgcggtgggaacaatataggaagcaaatctgtccactggtaccagcaaaaaccaggacaagcccctgttctggtcgtctatgatgacagcgacagaccaagtggtattcccgagagattctccggtagcaactctggaaatacagctactttgaccatctccagagttgaggctggtgacgaggcagattactattgccaggtctgggacagctccagcgaccacgtcgtattcggtggcgggaccaagctgactgtgctgggcggctccgagggcaagagcagcggcagcggcagcgagagcaagagcaccggcggcagccaggtgcagttggtagagtcaggagggggcctcgttcaacctggtggcagcctccgtttgtcttgtgctgccagtggatttactttcagtcactacgcaatgagctgggtgagacaagcacctggcaagggccttgagtgggtctccactatcggcggttcaggggggagcacttactacgctgactctgtaaaaggtcgctttactatatctagagataactctaaaaacacactctacttgcagatgaacagcctgcgagccgaagatacagccgtgtactactgcgccaagcctcatattgtaatggtcactgccctcttgtatgatggcatggatgtttggggccaagggacaatggtgacagtctcaagcgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 339 - DNA, 1365 bp, Artificial Sequence
  Description of Artificial Sequence: Synthetic polynucleotide
caggttcagctgcaagagtctggccctggcctggtcaagccttccgagacactgtctctgacctgcaccgtgtctggcggctccatctcctcctactactggtcctggatcagacagcctcctggcaaaggcctggaatggatcggctacatctactactccggctccaccaactacaaccccagcctgaagtccagagtgaccatctccgtggacacctccaagaaccagttctccctgaagctgtcctccgtgaccgctgctgataccgccgtgtactattgtgctggcaccaccatcttcggcgtggtcacccctaacttctactacggcatggacgtgtggggccaaggcacaacagtgacagtctcttctgcctccaccaagggtccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 340 - protein, 7 aa, Artificial Sequence
  Description of Artificial Sequence: Synthetic peptide
NNNAAWS

SEQ ID NO: 341 - protein, 18 aa, Artificial Sequence
  Description of Artificial Sequence: Synthetic peptide
RTYYRSKWLYDYAYSYKS

SEQ ID NO: 342 - protein, 8 aa, Artificial Sequence
  Description of Artificial Sequence: Synthetic peptide
GYSSSFDY

SEQ ID NO: 343 - protein, 14 aa, Artificial Sequence
  Description of Artificial Sequence: Synthetic peptide
TGTSSNIGTYKFVS

SEQ ID NO: 344 - protein, 7 aa, Artificial Sequence
  Description of Artificial Sequence: Synthetic peptide
EVSKRPS

SEQ ID NO: 345 - protein, 10 aa, Artificial Sequence
  Description of Artificial Sequence: Synthetic peptide
VSYAGSGTLL

SEQ ID NO: 346 - protein, 120 aa, Artificial Sequence
  Description of Artificial Sequence: Synthetic polypeptide
QVQLQQSGPRLVRPSQTLSLTCAISGDSVFNNNAAWSWIRQSPSRGLEWLGRTYYRSKWLYDYAVSVKSRITVNPDTSRNQFTLQLNSVTPEDTALYYCARGYSSSFDYWGQGTLVTVSS

SEQ ID NO: 347 - protein, 110 aa, Artificial Sequence
  Description of Artificial Sequence: Synthetic polypeptide
QSALTQPASVSGSPGQSITISCTGTSSNIGTYKFVSWYQQHPDKAPKVLLYEVSKRPSGVSSRFSGSKSGNTASLTISGLQAEDQADYHCVSYAGSGTLLFGGGTKLTVL

SEQ ID NO: 348 - protein, 243 aa, Artificial Sequence; identical to SEQ ID NO: 68
  Description of Artificial Sequence: Synthetic polypeptide

SEQ ID NO: 349 - protein, 449 aa, Artificial Sequence
  Description of Artificial Sequence: Synthetic polypeptide
QVQLQQSGPRLVRPSQTLSLTCAISGDSVFNNNAAWSWIRQSPSRGLEWLGRTYYRSKWLYDYAVSVKSRITVNPDTSRNQFTLQLNSVTPEDTALYYCARGYSSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 350 - protein, 216 aa, Artificial Sequence
  Description of Artificial Sequence: Synthetic polypeptide
QSALTQPASVSGSPGQSITISCTGTSSNIGTYKFVSWYQQHPDKAPKVLLYEVSKRPSGVSSRFSGSKSGNTASLTISGLQAEDQADYHCVSYAGSGTLLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 351 - DNA, 1347 bp, Artificial Sequence
  Description of Artificial Sequence: Synthetic polynucleotide
caggtgcagctccaacagagtggtcccagactcgtgagaccctctcaaacactcagtttgacttgtgccatctcaggcgattcagttttcaacaacaatgcagcttggagctggattaggcagtcacctagtcgcggtcttgaatggcttgggcgtacatactatcgctctaaatggttgtatgattacgctgtgtccgtgaagagccgaatcaccgtaaaccctgatacctccaggaatcagttcacattgcaactgaatagtgtgactcccgaggatactgcactctattattgtgcccgaggatatagcagtagcttcgactattggggacaagggacactcgttaccgttagttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 352 - DNA, 648 bp, Artificial Sequence
  Description of Artificial Sequence: Synthetic polynucleotide
cagtctgctctgacccagcctgcctccgtgtctggctctcccggccagtccatcaccatcagctgtaccggcacctcctccaacatcggcacctacaagttcgtgtcctggtatcagcagcaccccgacaaggcccccaaagtgctgctgtacgaggtgtccaagcggccctctggcgtgtcctccagattctccggctccaagtctggcaacaccgcctccctgaccatcagcggactgcaggctgaggaccaggccgactaccactgtgtgtcctacgctggctctggcaccctgctgtttggcggaggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 353 - DNA, 1422 bp, Artificial Sequence
  Description of Artificial Sequence: Synthetic polynucleotide
gacatacaaatgacacaatcaccctcttctctttctgcaagcgttggcgaccgtgtcactatcacttgtcgagcccgccagtccataggtactgccattcactggtatcaacagaagcctggcaaggctcccaaactcctgattaagtatgccagcgagagcatttccggcgtaccttcaagattttccggctccggtagtgggacagatttcactctcactatatctagcctccaaccagaagatttcgccacttactactgtcaacaatcaggttcatggccttacactttcggccaggggacaaaattggagatcaagggcggctccgagggcaagagcagcggcagcggcagcgagagcaagagcaccggcggcagcgaggtgcaactggtggagtctgggggaggcctggtcaagcctggggggtccctgagactctcctgtgcagcctctggattcaccttcagtagatataacatgaactgggtccgccaggctccagggaaggggctggagtgggtctcatccattagtactagtagtaattacatatactacgcagactcagtgaagggccgattcaccttctccagagacaacgccaagaactcactggatctgcaaatgagcggcctgagagccgaggacacggctatttattactgtacgagaggctgggggccttttgactactggggccagggaaccctggtcaccgtctcctcagagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 354 - DNA, 1425 bp, Artificial Sequence
  Description of Artificial Sequence: Synthetic polynucleotide
gacatccagatgacccagtctccatcctctctgtccgcctctgtgggcgacagagtgaccattacctgccgggccagacagtctatcggcaccgctatccactggtatcagcagaagcctggcaaggcccctaagctgctgattaagtacgcctccgagtccatctccggcgtgccctccagattttctggctctggatctggcaccgactttaccctgacaatctccagcctgcagcctgaggacttcgccacctactactgtcagcagtccggctcttggccttacacctttggtcagggcaccaagctggaaatcaagggcggatctgagggaaagtccagcggctccggcagcgaaagcaagtccaccggcggaagcgaggtgcagctggttgaatctggcggaggactggttaagcctggcggctctctgagactgtcttgtgctgcttctggcttcaccttcagccggtacaacatgaactgggtccgacaggctcctggcaaaggcctggaatgggtgtcctccatctccacctccagcaactacatctactacgccgactccgtgaagggcagattcaccttctccagagacaacgccaagaactccctggacctgcagatgtctggcctgagagctgaggacaccgctatctactactgcaccagaggctggggacccttcgattattggggccagggaaccctggtcaccgtgtcatctgagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 355 - protein, 240 aa, Artificial Sequence
  Description of Artificial Sequence: Synthetic polypeptide
VPLIEGRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHYSEKVTEFMLCAGLWTGGKDTCGGDSGGPLVCNGVLQGITSWGPEPCALPEKPAVYTKVVHYRKWIKDTIAANPHHHHHH

SEQ ID NO: 356 - protein, 117 aa, Artificial Sequence
  Description of Artificial Sequence: Synthetic polypeptide
  MOD_RES (16)..(16): D or Q
  MOD_RES (23)..(23): A or T
  MOD_RES (41)..(41): P or F
  MOD_RES (45)..(45): G or R
  MOD_RES (49)..(49): I or M
  MOD_RES (70)..(70): I or M
  MOD_RES (88)..(88): A or P
  MOD_RES (89)..(89): V or A
QVQLQESGPGLVKPSXTLSLTCXVSGNSITSDYAWNWIRQXPGKXLEWXGYISYSGSTTYNPSLKSRVTXSRDTSKNQFSLKLSSVTXXDTAVYYCATGYYYGSGFWGQGTLVTVSS

SEQ ID NO: 357 - protein, 112 aa, Artificial Sequence
  Description of Artificial Sequence: Synthetic polypeptide
  MOD_RES (1)..(1): D or E
  MOD_RES (9)..(9): D or A
  MOD_RES (10)..(10): S or T
  MOD_RES (12)..(12): A or S
  MOD_RES (13)..(13): V or L
  MOD_RES (15)..(15): L or P
  MOD_RES (21)..(21): I or L
  MOD_RES (22)..(22): N or S
  MOD_RES (24)..(24): R or K
  MOD_RES (49)..(49): K or R
  MOD_RES (58)..(58): V or R
  MOD_RES (62)..(62): V or I
  MOD_RES (64)..(64): A or D
  MOD_RES (80)..(80): Q or S
  MOD_RES (82)..(82): L or V
  MOD_RES (83)..(83): Q or E
  MOD_RES (85)..(85): P or A
  MOD_RES (88)..(88): F or V
  MOD_RES (89)..(89): A or S
  MOD_RES (92)..(92): Y or F
  MOD_RES (105)..(105): Q or G
  MOD_RES (109)..(109): L or V
XIVLTQSPXXLXXSXGERATXXCXASESVEYFGTSLMHWYQQKPGQPPXLLIYAASNXESGXPXRFSGSGSGTDFTLTIXSXXQXEDXXVYXCQQTRKVPYTFGXGTKXEIK

SEQ ID NO: 358 - protein, 106 aa, Artificial Sequence
  Description of Artificial Sequence: Synthetic polypeptide
SYELTQPPSVSVSPGETASITCSGDQLGENYASWYQQKPGQSPVLVIYQDSKRPSGIPERFSGSNSGNTATLTISGTQALDEADYYCQAWDNSIVVFGGGTKLTVL

SEQ ID NO: 359 - protein, 212 aa, Artificial Sequence
  Description of Artificial Sequence: Synthetic polypeptide
SYELTQPPSVSVSPGETASITCSGDQLGENYASWYQQKPGQSPVLVIYQDSKRPSGIPERFSGSNSGNTATLTISGTQALDEADYYCQAWDNSIVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 360 - DNA, 636 bp, Artificial Sequence
  Description of Artificial Sequence: Synthetic polynucleotide
agttatgagctgactcaaccacccagtgtcagcgtatccccaggagaaactgcctctataacatgcagcggagaccagttgggagaaaattacgcctcctggtaccaacagaagcctggacaaagtcctgtcctcgttatttatcaagattctaaacgtccctctgggatccccgaacgattctccggctctaactctgggaataccgctaccttgacaataagtggtacacaggcacttgatgaagctgattattactgccaggcatgggataacagcattgtggttttcgggggcggcaccaaactcacagttctcggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 361 - DNA, 357 bp, Artificial Sequence; identical to SEQ ID NO: 233
  Description of Artificial Sequence: Synthetic polynucleotide

SEQ ID NO: 362 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagttactatggcatgcactgggtccgccaggctccaggcaaggggctggagtgggtggcatttatatcatatgatggaagtaataaatactatgcagactccgtgaagggccgattcaccatctccagagacaattccaagaacacgctgtatctgcaaatgaacagcctgagagctgaggacacggctgtgtattactgtgcccacctcccttatagtgggagctactgggcctttgactactggggccagggaacccaggtcaccgtctcttca

SEQ ID NO: 363 - protein, 107 aa, Artificial Sequence [sequence omitted]

SEQ ID NO: 364 - protein, 106 aa, Artificial Sequence
  Description of Artificial Sequence: Synthetic polypeptide
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 365 - protein, 252 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSSGGSEGKSSGSGSESKSTGGSDIQMTQSPSFLSASVGDRVTITCRASQGISSYLAWYQQKPGKAPKFLIYAASTLQSGVPSRFSGSGSGTEFTLTISSLQPEDFATYYCQQLNSYPLTFGGGTKVEIK

SEQ ID NO: 366 - protein, 252 aa, Artificial Sequence
  Description of Artificial Sequence: Synthetic polypeptide
DIQMTQSPSFLSASVGDRVTITCRASQGISSYLAWYQQKPGKAPKFLIYAASTLQSGVPSRFSGSGSGTEFTLTISSLQPEDFATYYCQQLNSYPLTFGGGTKVEIKGGSEGKSSGSGSESKSTGGSQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSS

SEQ ID NO: 367 - protein, 250 aa, Artificial Sequence
  Description of Artificial Sequence: Synthetic polypeptide
EVQLVESGGGVVQPGRSLRLSCVASGFTFSSYDIHWVRQAPGKGLEWVAIISYDGSKKDYTDSVKGRFTISRDNSKNTLYLQMDSLRVEDSAVYSCARESGWSHYYYYGMDVWGQGTMVTVSSGGSEGKSSGSGSESKSTGGSDIVMTQSPSSLSASVGDRVTITCRASQDISNYLAWYQQKPGKVPKFLIYAASTLHSGVPSRFSGSGSGTDFTLTISSLQPEDVATYYCQKYNSAPYTFGQGTRLEIK

SEQ ID NO: 368 - protein, 250 aa, Artificial Sequence
  Description of Artificial Sequence: Synthetic polypeptide
DIVMTQSPSSLSASVGDRVTITCRASQDISNYLAWYQQKPGKVPKFLIYAASTLHSGVPSRFSGSGSGTDFTLTISSLQPEDVATYYCQKYNSAPYTFGQGTRLEIKGGSEGKSSGSGSESKSTGGSEVQLVESGGGVVQPGRSLRLSCVASGFTFSSYDIHWVRQAPGKGLEWVAIISYDGSKKDYTDSVKGRFTISRDNSKNTLYLQMDSLRVEDSAVYSCARESGWSHYYYYGMDVWGQGTMVTVSS

SEQ ID NO: 369 - protein, 245 aa, Artificial Sequence
  Description of Artificial Sequence: Synthetic polypeptide
QVQLQESGPGLVKPSETLSLTCTVSGGSISSYYWSWLRQPAGSGLEWIGRLYVSGFTNYNPSLKSRVTLSLDPSRNQLSLKLSSVTAADTAVYYCAGDSGNYWGWFDPWGQGTLVTVSSGGSEGKSSGSGSESKSTGGSSYELTQPPSVSVSPGETASITCSGDQLGENYACWYQQKPGQSPVLVIYQDSKRPSGIPERFSGSNSGNTATLTISGTQALDEADYYCQAWDNSIVVFGGGTKLTVL

SEQ ID NO: 370 - protein, 245 aa, Artificial Sequence
  Description of Artificial Sequence: Synthetic polypeptide
SYELTQPPSVSVSPGETASITCSGDQLGENYACWYQQKPGQSPVLVIYQDSKRPSGIPERFSGSNSGNTATLTISGTQALDEADYYCQAWDNSIVVFGGGTKLTVLGGSEGKSSGSGSESKSTGGSQVQLQESGPGLVKPSETLSLTCTVSGGSISSYYWSWLRQPAGSGLEWIGRLYVSGFTNYNPSLKSRVTLSLDPSRNQLSLKLSSVTAADTAVYYCAGDSGNYWGWFDPWGQGTLVTVSS

SEQ ID NO: 371 - protein, 419 aa, Artificial Sequence
  Description of Artificial Sequence: Synthetic polypeptide
MIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDMGGGGSGGGGSGGGGSGSHSMRYFSAAVSRPGRGEPRFIAMGYVDDTQFVRFDSDSASPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIGGGGSGLNDIFEAQKIEWHE

SEQ ID NO: 372 - protein, 456 aa, Artificial Sequence
  Description of Artificial Sequence: Synthetic polypeptide
RIIPRHLQLGGGGSGGGGSIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDMGGGGSGGGGSGGGGSGSHSMRYFSAAVSRPGRGEPRFIAMGYVDDTQFVRFDSDSASPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWSKEGDGGIMSVRESRSLSEDLGGGGSHHHHHHGSGLNDIFEAQKIEWHE

SEQ ID NO: 373 - protein, 314 aa, Artificial Sequence
  Description of Artificial Sequence: Synthetic polypeptide
GSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 374 - DNA, 1359 bp, Artificial Sequence
  Description of Artificial Sequence: Synthetic polynucleotide
atggcttgggtgtggacattgttgtttctgatggctgctgctcaatctattcaagctaggatcattcctagacatctgcaactcggaggcggaggcagcggaggaggaggatctggaggaggaggatctattcagaggacacctaagattcaagtgtactctagacatcctgctgagaacggcaagagcaactttctgaactgctatgtgagcggctttcatcctagcgatattgaagtggatctgctgaaaaacggcgaacgtattgaaaaagtggaacatagcgatctgagctttagcaaagattggagcttttatctgctgtattataccgaatttacccctaccgaaaaagatgaatatgcctgcagagtgaaccatgtgaccctgagccagcctaagattgtgaaatgggatagagatatgggaggaggaggctctggaggaggaggatctggaggcggaggcagcggctctcatagcatgagatattttagcgctgcagtgagccgtcctggacgtggagaacctaggtttattgctatgggctatgtggatgatacccagtttgtgaggtttgatagcgatagcgcctctcctaggatggaacctagagctccctgggtggaacaggaaggcccagaatattgggaagaagaaaccaggaacaccaaagcacatgctcagaccgatcgtatgaacctgcagaccctgagaggctattataaccagagcgaagcatctagccataccctgcagtggatgattggctgcgatctgggcagcgatggcagactgctgagaggctatgaacagtatgcatatgatggcaaagattatctggcactgaacgaagatctgaggagctggaccgctgctgataccgctgctcagattagcaagaggaagtgcgaagctgctaacgtggctgaacagagacgcgcatatctggaaggcacctgcgtggaatggctgcataggtatctggaaaacggcaaagaaatgctgcagagagctgatcctcctaaaacccatgtgacccatcatcctgtgtttgattatgaagctaccctgaggtgctgggctctgggcttctatcctgctgagattattctgacctggcagagagatggagaagatcagactcaagatgtcgagttggtcgagactagacctgctggagatggcacctttcagaagtgggcagctgttgtcgtgcctagcggagaagaacagagatatacctgccatgtgcagcatgaaggcctgcctgaacctctgatgctgaggtggaaacagagcagcttgcctactattcctattggaggaggaggatctcaccatcatcatcatcactga

SEQ ID NO: 375 - protein, 435 aa, Artificial Sequence
  Description of Artificial Sequence: Synthetic polypeptide
QARIIPRHLQLGGGGSGGGGSGGGGSIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDMGGGGSGGGGSGGGGSGSHSMRYFSAAVSRPGRGEPRFIAMGYVDDTQFVRFDSDSASPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIGGGGSHHHHHH

SEQ ID NO: 376 - DNA, 1359 bp, Artificial Sequence; identical to SEQ ID NO: 374
  Description of Artificial Sequence: Synthetic polynucleotide

SEQ ID NO: 377 - protein, 433 aa, Artificial Sequence
  Description of Artificial Sequence: Synthetic polypeptide
RIIPRHLQLGGGGSGGGGSGGGGSIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDMGGGGSGGGGSGGGGSGSHSMRYFSAAVSRPGRGEPRFIAMGYVDDTQFVRFDSDSASPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIGGGGSHHHHHH

SEQ ID NO: 378 - protein, 312 aa, Artificial Sequence
  Description of Artificial Sequence: Synthetic polypeptide
GSHSMRYFYTAVSRPGRGQPRFIAVGYVDDTQFVRFDSDAESPRMEPRAPWVEQEGPEYWDRETQNMKTATQTYQANLRTLLRYYNQSEAGSHTFQKMYGCDLGPDGRLLRGYEQFAYDGRDYIILNEDLRSWTAADMAAQNTQRKWEAAGAAEQHRTYLEGECLEWLRRYLENGKETLQRADPPKTNVTHHPVSDYEATLRCWALGFYPAEITLTWQRDGEEQTEDTELVETRPTGDGTFQKWAAVVVPSGEEQRYTCHVQHEGLPKPLTLRWEPSSQSTILIGGGGSHHHHHHGSGLNDIFEAQKIEWHE

SEQ ID NO: 379 - protein, 99 aa, Artificial Sequence
  Description of Artificial Sequence: Synthetic polypeptide
IQRTPKIQVYSRHPPENGKPNFLNCYVSGFHPSDIEVDLLKNGEKMGKVEHSDLSFSKDWSFYLLYYTEFTPNEKDEYACRVNHVTLSGPRTVKWDRDM

SEQ ID NO: 380 - protein, 125 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITINPDTSKNQISLQLNSVTPEDTAVYYCAGDRRYGIVGLPFAYWGQGTLVTVSS

SEQ ID NO: 381 - protein, 113 aa, Artificial Sequence
  Description of Artificial Sequence: Synthetic polypeptide
DIVMTQSPDSLAVSLGERATINCKSSQSVLHSSNNKNYLTWFQQKPGQPPKLLIYWASTRESGVPDRFSGSGSGTDFTLTISSLQAEDVAVYYCHQYYSTPPTFGQGTKVEIK

SEQ ID NO: 382 - protein, 122 aa, Artificial Sequence
  Description of Artificial Sequence: Synthetic polypeptide
QVQLQQSGPGLVKPSQTLSLTCAISGDSVSNNSAAWNWIRQSPSRGLEWLGRTYYRSKWYNDYAVSVKSRITINPDTSKNQFSLQLNSVTPEDTAVYYCARYGSGTLLFDYWGQGTLVTVSS

SEQ ID NO: 383 - protein, 114 aa, Artificial Sequence
  Description of Artificial Sequence: Synthetic polypeptide
DIVMTQSPDSLAVSLGERATINCKSSQSVLYSSKNKNYLAWYQQKPGQPPKLLIYWASTRESGVPDRFSGSGSGTDFTLTISSLQAEDVAVYYCQQYYSTFPYTFGQGTKLEIK

SEQ ID NO: 384 - protein, 125 aa, Artificial Sequence
  Description of Artificial Sequence: Synthetic polypeptide
QVQLQQSGPGLVRPSQTLSVTCAISGDSVSSNSASWNWIRQSPSRGLEWLGRTYYRSEWFNDYAVSVKSRVTINPDTSKNQLSLQLNSVIPEDTAVYYCAREARIGVAGKGFDYWGQGTLVTVSS

SEQ ID NO: 385 - protein, 113 aa, Artificial Sequence
  Description of Artificial Sequence: Synthetic polypeptide
DIVMTQSPDSLAVSLGERATINCKSSQSVLFRSNNKNYLAWFQQKPGQPPKLLIYWASTRESGVPDRFSGSGSGTDFTLTISSLQAEDVAVYYCQQYYSTPRTFGQGTKVEIK

SEQ ID NO: 386 - protein, 121 aa, Artificial Sequence
  Description of Artificial Sequence: Synthetic polypeptide
QVQLQQSGPGLVKPSQTLSLTCAISGDSVSSNRAAWNWIRQTPSRGLEWLGRTYYRSEWYNDYAVSVKSRITINPDTSKNQFSLQLNSVTPEDTAVYYCARVRAAVPFDYWGQGTLVTVSS

SEQ ID NO: 387 - protein, 113 aa, Artificial Sequence
  Description of Artificial Sequence: Synthetic polypeptide
DIVMTQSPDSLAVSLGERATINCKSSQSVLFSSNNKNYLAWYQQKPGQPPNLLIYWASTRESGVPDRFSGSVSGTDFTLTISSLQAEDVAIYYCQQYHSTPWTFGQGTKVEIK

SEQ ID NO: 388 - protein, 117 aa, Artificial Sequence
  Description of Artificial Sequence: Synthetic polypeptide
QLQLQESGPGLVKPSETLSLMCTVSGGSITSSSYYWGWIRQPPGKGLEWIGNIYYSGTTYYNPSLKSRVTISVDTSKNQFSLKLSSVTAADTAVYYCAAGARDFDSWGQGSLVTVSS

SEQ ID NO: 389 - protein, 115 aa, Artificial Sequence
  Description of Artificial Sequence: Synthetic polypeptide
DIVMTQSPDSLAVSLGERATINCKSSQSVLYSSSNKSYLAWYQQRPGQPPKLLIYWASTRESGVPDRFSGSGSGTDFTLTISSLQAEDVAVYYCQQYYSTPRMYTFGQGTKLEIK

SEQ ID NO: 390 - protein, 121 aa, Artificial Sequence
  Description of Artificial Sequence: Synthetic polypeptide
EVQLLESGPGLVKPSQTLSLTCVISGDSVSSNRAAWNWIRQSPSRGLEWLGRTYYRSKWYNDYAVSVKSRITINSDTSKNQISLQLNSVTPEDTAVYYCARVRPGIPFDYWGQGTPVTVSS

SEQ ID NO: 391 - protein, 113 aa, Artificial Sequence
  Description of Artificial Sequence: Synthetic polypeptide
DIVMTQSPDSLAVSLGERATINCKSSQSVLFSSNKKNYLAWYQQKPGQPPKLLIYWASTRESGVPDRFSGSGSGTDFTLTISSLQAEDVAVYYCQQYNSTPWTFGQGTKVEIK

SEQ ID NO: 392 - protein, 121 aa, Artificial Sequence
  Description of Artificial Sequence: Synthetic polypeptide
QVQLQQSGPGLVKPSQTLSLTCVISGDSVSSNRAAWNWIRQSPSRGLEWLGRTYYRSKWYNDYAVSVKSRITINSDTSKNQISLQLNSVTPEDTAVYYCARVRPGIPFDYWGQGTTVTVSS

SEQ ID NO: 393 - protein, 113 aa, Artificial Sequence
  Description of Artificial Sequence: Synthetic polypeptide
DIQMTQSPDSLAVSLGERATINCESSQSVLFSSNKKNYLAWYQQKPGQPPKLLIYWASTRESGVPDRFSGSGSGTDFTLTINRLQAEDVAVYYCQQYNSTPWTFGQGTKVEIK

SEQ ID NO: 394 - protein, 120 aa, Artificial Sequence
  Description of Artificial Sequence: Synthetic polypeptide
EVQLLESGGGLVQPGGSLRLSCAASGFTFSSYAMHWVRQAPGKGLDWVSGISGSGFSTYYVDSVKGRFTISRDNSKHTLYLQMNSLRAEDTAVYYCAKDNLVAGTVFDYWGQGTLVTVSS

SEQ ID NO: 395 - protein, 107 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSGTEFTLTISSLQPDDFATYYCQQYNSYSLTFGGGTKVDIK

SEQ ID NO: 396 - protein, 120 aa, Artificial Sequence
  Description of Artificial Sequence: Synthetic polypeptide
EVQLLESGGGLVQPGGSLRLSCAASGFTFSSYAMHWVRQAPGKGLEWVSGISGSGFSTYYVDSVKGRFTISRDNSKNTLYLQMNSLRAEDTAVYYCAKDNLVAGTVFDYWGQGTLVTVSS

SEQ ID NO: 397 - protein, 107 aa, Artificial Sequence; identical to SEQ ID NO: 395
  Description of Artificial Sequence: Synthetic polypeptide

SEQ ID NO: 398 - protein, 121 aa, Artificial Sequence
  Description of Artificial Sequence: Synthetic polypeptide
QVQLQQSGPGLVKPSQTLSLTCAISGDSVSSNRAAWNWIRQSPSRGLEWLGRTYYRSKWYNDYAVSVKSRITINPDTSKNQISLQLNSVTPEDTAVYYCARVRPGIPFDYWGQGTPVTVSS

SEQ ID NO: 399 - protein, 113 aa, Artificial Sequence
  Description of Artificial Sequence: Synthetic polypeptide
DIVMTQSPDSLAVSLGERATINCKSSQSVLFSSNNKNYLAWYQQKPGQPPKLLIYWASTRESGVPDRFSGSVSGTDFTLTISSLQAEDVAVYYCQQYHSTPWTFGQGTKVEIK

SEQ ID NO: 400 - protein, 7 aa, Artificial Sequence
  Description of Artificial Sequence: Synthetic peptide
SNSAAWN

SEQ ID NO: 401 - protein, 18 aa, Artificial Sequence
  Description of Artificial Sequence: Synthetic peptide
RTYYRSKWYNDYAVSVKS

SEQ ID NO: 402 - protein, 13 aa, Artificial Sequence
  Description of Artificial Sequence: Synthetic peptide
DRRYGIVGLPFAY

SEQ ID NO: 403 - protein, 7 aa, Artificial Sequence
  Description of Artificial Sequence: Synthetic peptide
NNSAAWN

SEQ ID NO: 404 - skipped

SEQ ID NO: 405 - protein, 10 aa, Artificial Sequence
  Description of Artificial Sequence: Synthetic peptide
YGSGTLLFDY

SEQ ID NO: 406 - protein, 7 aa, Artificial Sequence
  Description of Artificial Sequence: Synthetic peptide
SNSASWN

SEQ ID NO: 407 - protein, 18 aa, Artificial Sequence
  Description of Artificial Sequence: Synthetic peptide
RTYYRSEWFNDYAVSVKS

SEQ ID NO: 408 - protein, 13 aa, Artificial Sequence
  Description of Artificial Sequence: Synthetic peptide
EARIGVAGKGFDY

SEQ ID NO: 409 - protein, 7 aa, Artificial Sequence
  Description of Artificial Sequence: Synthetic peptide
SNRAAWN

SEQ ID NO: 410 - protein, 18 aa, Artificial Sequence
  Description of Artificial Sequence: Synthetic peptide
RTYYRSEWYNDYAVSVKS

SEQ ID NO: 411 - protein, 9 aa, Artificial Sequence
  Description of Artificial Sequence: Synthetic peptide
VRAAVPFDY

SEQ ID NO: 412 - protein, 7 aa, Artificial Sequence
  Description of Artificial Sequence: Synthetic peptide
SSSYYWG

SEQ ID NO: 413 - protein, 16 aa, Artificial Sequence
  Description of Artificial Sequence: Synthetic peptide
NIYYSGTTYYNPSLKS

SEQ ID NO: 414 - protein, 7 aa, Artificial Sequence
  Description of Artificial Sequence: Synthetic peptide
GARDFDS

SEQ ID NO: 415 - protein, 9 aa, Artificial Sequence
  Description of Artificial Sequence: Synthetic peptide
VRPGIPFDY

SEQ ID NO: 416 - protein, 5 aa, Artificial Sequence
  Description of Artificial Sequence: Synthetic peptide
SYAMH

SEQ ID NO: 417 - protein, 17 aa, Artificial Sequence
  Description of Artificial Sequence: Synthetic peptide
GISGSGFSTYYVDSVKG

SEQ ID NO: 418 - protein, 11 aa, Artificial Sequence
  Description of Artificial Sequence: Synthetic peptide
DNLVAGTVFDY

SEQ ID NO: 419 - protein, 17 aa, Artificial Sequence
  Description of Artificial Sequence: Synthetic peptide
KSSQSVLHSSNNKNYLT

SEQ ID NO: 420 - protein, 7 aa, Artificial Sequence
  Description of Artificial Sequence: Synthetic peptide
WASTRES

SEQ ID NO: 421 - protein, 9 aa, Artificial Sequence
  Description of Artificial Sequence: Synthetic peptide
HQYYSTPPT

SEQ ID NO: 422 - protein, 17 aa, Artificial Sequence
  Description of Artificial Sequence: Synthetic peptide
KSSQSVLYSSKNKNYLA

SEQ ID NO: 423 - protein, 10 aa, Artificial Sequence
  Description of Artificial Sequence: Synthetic peptide
QQYYSTFPYT

SEQ ID NO: 424 - protein, 17 aa, Artificial Sequence
  Description of Artificial Sequence: Synthetic peptide
KSSQSVLFRSNNKNYLA

SEQ ID NO: 425 - protein, 9 aa, Artificial Sequence
  Description of Artificial Sequence: Synthetic peptide
QQYYSTPRT

SEQ ID NO: 426 - protein, 17 aa, Artificial Sequence
  Description of Artificial Sequence: Synthetic peptide
KSSQSVLFSSNNKNYLA

SEQ ID NO: 427 - protein, 9 aa, Artificial Sequence
  Description of Artificial Sequence: Synthetic peptide
QQYHSTPWT

SEQ ID NO: 428 - protein, 17 aa, Artificial Sequence
  Description of Artificial Sequence: Synthetic peptide
KSSQSVLYSSSNKSYLA

SEQ ID NO: 429 - protein, 11 aa, Artificial Sequence
  Description of Artificial Sequence: Synthetic peptide
QQYYSTPRMYT

SEQ ID NO: 430 - protein, 17 aa, Artificial Sequence
  Description of Artificial Sequence: Synthetic peptide
KSSQSVLFSSNKKNYLA

SEQ ID NO: 431 - protein, 9 aa, Artificial Sequence
  Description of Artificial Sequence: Synthetic peptide
QQYNSTPWT

SEQ ID NO: 432 - protein, 17 aa, Artificial Sequence
  Description of Artificial Sequence: Synthetic peptide
ESSQSVLFSSNKKNYLA

SEQ ID NO: 433 - protein, 11 aa, Artificial Sequence
  Description of Artificial Sequence: Synthetic peptide
RASQSISSWLA

SEQ ID NO: 434 - protein, 7 aa, Artificial Sequence
  Description of Artificial Sequence: Synthetic peptide
KASSLES

SEQ ID NO: 435 - protein, 9 aa, Artificial Sequence
  Description of Artificial Sequence: Synthetic peptide
QQYNSYSLT

SEQ ID NO: 436 - protein, 9 aa, Artificial Sequence
  Description of Artificial Sequence: Synthetic peptide
GDSVSSNSA

SEQ ID NO: 437 - protein, 7 aa, Artificial Sequence
  Description of Artificial Sequence: Synthetic peptide
YYRSKWY

SEQ ID NO: 438 - protein, 12 aa, Artificial Sequence
  Description of Artificial Sequence: Synthetic peptide
DRRYGIVGLPFA

SEQ ID NO: 439 - protein, 9 aa, Artificial Sequence
  Description of Artificial Sequence: Synthetic peptide
GDSVSNNSA

SEQ ID NO: 440 - protein, 9 aa, Artificial Sequence
  Description of Artificial Sequence: Synthetic peptide
YGSGTLLFD

SEQ ID NO: 441 - protein, 7 aa, Artificial Sequence
  Description of Artificial Sequence: Synthetic peptide
YYRSEWF

SEQ ID NO: 442 - protein, 12 aa, Artificial Sequence
  Description of Artificial Sequence: Synthetic peptide
EARIGVAGKGFD

SEQ ID NO: 443 - protein, 9 aa, Artificial Sequence
  Description of Artificial Sequence: Synthetic peptide
GDSVSSNRA

SEQ ID NO: 444 - protein, 7 aa, Artificial Sequence
  Description of Artificial Sequence: Synthetic peptide
YYRSEWY

SEQ ID NO: 445 - protein, 8 aa, Artificial Sequence
  Description of Artificial Sequence: Synthetic peptide
VRAAVPFD

SEQ ID NO: 446 - protein, 9 aa, Artificial Sequence
  Description of Artificial Sequence: Synthetic peptide
GGSITSSSY

SEQ ID NO: 447 - protein, 5 aa, Artificial Sequence
  Description of Artificial Sequence: Synthetic peptide
YYSGT

SEQ ID NO: 448 - protein, 6 aa, Artificial Sequence
  Description of Artificial Sequence: Synthetic peptide
GARDFD

SEQ ID NO: 449 - protein, 8 aa, Artificial Sequence
  Description of Artificial Sequence: Synthetic peptide
VRPGIPFD

SEQ ID NO: 450 - protein, 7 aa, Artificial Sequence
  Description of Artificial Sequence: Synthetic peptide
GFTFSSY

SEQ ID NO: 451 - protein, 6 aa, Artificial Sequence
  Description of Artificial Sequence: Synthetic peptide
SGSGFS

SEQ ID NO: 452 - protein, 10 aa, Artificial Sequence
  Description of Artificial Sequence: Synthetic peptide
DNLVAGTVFD

SEQ ID NO: 453 - protein, 13 aa, Artificial Sequence
  Description of Artificial Sequence: Synthetic peptide
SQSVLHSSNNKNY

SEQ ID NO: 454 - protein, 3 aa, Artificial Sequence
  Description of Artificial Sequence: Synthetic peptide
WAS

SEQ ID NO: 455 - protein, 6 aa, Artificial Sequence
  Description of Artificial Sequence: Synthetic peptide
YYSTPP

SEQ ID NO: 456 - protein, 13 aa, Artificial Sequence
  Description of Artificial Sequence: Synthetic peptide
SQSVLYSSKNKNY

SEQ ID NO: 457 - protein, 7 aa, Artificial Sequence
  Description of Artificial Sequence: Synthetic peptide
YYSTFPY

SEQ ID NO: 458 - protein, 13 aa, Artificial Sequence
  Description of Artificial Sequence: Synthetic peptide
SQSVLFRSNNKNY

SEQ ID NO: 459 - protein, 6 aa, Artificial Sequence
  Description of Artificial Sequence: Synthetic peptide
YYSTPR

SEQ ID NO: 460 - protein, 13 aa, Artificial Sequence
  Description of Artificial Sequence: Synthetic peptide
SQSVLFSSNNKNY

SEQ ID NO: 461 - protein, 6 aa, Artificial Sequence
  Description of Artificial Sequence: Synthetic peptide
YHSTPW

SEQ ID NO: 462 - protein, 13 aa, Artificial Sequence
  Description of Artificial Sequence: Synthetic peptide
SQSVLYSSSNKSY

SEQ ID NO: 463 - protein, 13 aa, Artificial Sequence
  Description of Artificial Sequence: Synthetic peptide
SQSVLFSSNKKNY

SEQ ID NO: 464 - protein, 6 aa, Artificial Sequence
  Description of Artificial Sequence: Synthetic peptide
YNSTPW

SEQ ID NO: 465 - protein, 7 aa, Artificial Sequence
  Description of Artificial Sequence: Synthetic peptide
SQSISSW

SEQ ID NO: 466 - protein, 3 aa, Artificial Sequence
  Description of Artificial Sequence: Synthetic peptide
KAS

SEQ ID NO: 467 - protein, 6 aa, Artificial Sequence
  Description of Artificial Sequence: Synthetic peptide
YNSYSL

SEQ ID NO: 468 - protein, 10 aa, Artificial Sequence
  Description of Artificial Sequence: Synthetic peptide
GDSVSSNSAA

SEQ ID NO: 469 - protein, 9 aa, Artificial Sequence
  Description of Artificial Sequence: Synthetic peptide
TYYRSKWYN

SEQ ID NO: 470 - protein, 15 aa, Artificial Sequence
  Description of Artificial Sequence: Synthetic peptide
AGDRRYGIVGLPFAY

SEQ ID NO: 471 - protein, 10 aa, Artificial Sequence
  Description of Artificial Sequence: Synthetic peptide
GDSVSNNSAA

SEQ ID NO: 472 - protein, 12 aa, Artificial Sequence
  Description of Artificial Sequence: Synthetic peptide
ARYGSGTLLFDY

SEQ ID NO: 473 - protein, 10 aa, Artificial Sequence
  Description of Artificial Sequence: Synthetic peptide
GDSVSSNSAS

SEQ ID NO: 474 - protein, 9 aa, Artificial Sequence
  Description of Artificial Sequence: Synthetic peptide
TYYRSEWFN

SEQ ID NO: 475 - protein, 15 aa, Artificial Sequence
  Description of Artificial Sequence: Synthetic peptide
AREARIGVAGKGFDY

SEQ ID NO: 476 - protein, 10 aa, Artificial Sequence
  Description of Artificial Sequence: Synthetic peptide
GDSVSSNRAA

SEQ ID NO: 477 - protein, 9 aa, Artificial Sequence
  Description of Artificial Sequence: Synthetic peptide
TYYRSEWYN

SEQ ID NO: 478 - protein, 11 aa, Artificial Sequence
  Description of Artificial Sequence: Synthetic peptide
ARVRAAVPFDY

SEQ ID NO: 479 - protein, 10 aa, Artificial Sequence
  Description of Artificial Sequence: Synthetic peptide
GGSITSSSYY

SEQ ID NO: 480 - protein, 7 aa, Artificial Sequence
  Description of Artificial Sequence: Synthetic peptide
IYYSGTT

SEQ ID NO: 481 - protein, 9 aa, Artificial Sequence
  Description of Artificial Sequence: Synthetic peptide
AAGARDFDS

SEQ ID NO: 482 - protein, 11 aa, Artificial Sequence
  Description of Artificial Sequence: Synthetic peptide
ARVRPGIPFDY

SEQ ID NO: 483 - protein, 8 aa, Artificial Sequence
  Description of Artificial Sequence: Synthetic peptide
GFTFSSYA

SEQ ID NO: 484 - protein, 8 aa, Artificial Sequence
  Description of Artificial Sequence: Synthetic peptide
ISGSGFST

SEQ ID NO: 485 - protein, 13 aa, Artificial Sequence
  Description of Artificial Sequence: Synthetic peptide
AKDNLVAGTVFDY

SEQ ID NO: 486 - protein, 12 aa, Artificial Sequence
  Description of Artificial Sequence: Synthetic peptide
QSVLHSSNNKNY

SEQ ID NO: 487 - protein, 9 aa, Artificial Sequence
  Description of Artificial Sequence: Synthetic peptide
HQYYSTPPT

SEQ ID NO: 488 - protein, 12 aa, Artificial Sequence
  Description of Artificial Sequence: Synthetic peptide
QSVLYSSKNKNY

SEQ ID NO: 489 - protein, 10 aa, Artificial Sequence
  Description of Artificial Sequence: Synthetic peptide
QQYYSTFPYT

SEQ ID NO: 490 - protein, 12 aa, Artificial Sequence
  Description of Artificial Sequence: Synthetic peptide
QSVLFRSNNKNY

SEQ ID NO: 491 - protein, 9 aa, Artificial Sequence
  Description of Artificial Sequence: Synthetic peptide
QQYYSTPRT

SEQ ID NO: 492 - protein, 12 aa, Artificial Sequence
  Description of Artificial Sequence: Synthetic peptide
QSVLFSSNNKNY

SEQ ID NO: 493 - protein, 9 aa, Artificial Sequence
  Description of Artificial Sequence: Synthetic peptide
QQYHSTPWT

SEQ ID NO: 494 - protein, 12 aa, Artificial Sequence
  Description of Artificial Sequence: Synthetic peptide
QSVLYSSSNKSY

SEQ ID NO: 495 - protein, 11 aa, Artificial Sequence
  Description of Artificial Sequence: Synthetic peptide
QQYYSTPRMYT

SEQ ID NO: 496 - protein, 12 aa, Artificial Sequence
  Description of Artificial Sequence: Synthetic peptide
QSVLFSSNKKNY

SEQ ID NO: 497 - protein, 9 aa, Artificial Sequence
  Description of Artificial Sequence: Synthetic peptide
QQYNSTPWT

SEQ ID NO: 498 - protein, 6 aa, Artificial Sequence
  Description of Artificial Sequence: Synthetic peptide
QSISSW

SEQ ID NO: 499 - protein, 9 aa, Artificial Sequence
  Description of Artificial Sequence: Synthetic peptide
QQYNSYSLT

SEQ ID NO: 500 - protein, 12 aa, Artificial Sequence
  Description of Artificial Sequence: Synthetic peptide
GDSVSSNSAAWN

SEQ ID NO: 501 - protein, 11 aa, Artificial Sequence
  Description of Artificial Sequence: Synthetic peptide
RTYYRSKWYND

SEQ ID NO: 502 - protein, 13 aa, Artificial Sequence
  Description of Artificial Sequence: Synthetic peptide
DRRYGIVGLPFAY

SEQ ID NO: 503 - protein, 12 aa, Artificial Sequence
  Description of Artificial Sequence: Synthetic peptide
GDSVSNNSAAWN

SEQ ID NO: 504 - protein, 10 aa, Artificial Sequence
  Description of Artificial Sequence: Synthetic peptide
YGSGTLLFDY

SEQ ID NO: 505 - protein, 12 aa, Artificial Sequence
  Description of Artificial Sequence: Synthetic peptide
GDSVSSNSASWN

SEQ ID NO: 506 - protein, 11 aa, Artificial Sequence
  Description of Artificial Sequence: Synthetic peptide
RTYYRSEWFND

SEQ ID NO: 507 - protein, 13 aa, Artificial Sequence
  Description of Artificial Sequence: Synthetic peptide
EARIGVAGKGFDY

SEQ ID NO: 508 - protein, 12 aa, Artificial Sequence
  Description of Artificial Sequence: Synthetic peptide
GDSVSSNRAAWN

SEQ ID NO: 509 - protein, 11 aa, Artificial Sequence
  Description of Artificial Sequence: Synthetic peptide
RTYYRSEWYND

SEQ ID NO: 510 - protein, 9 aa, Artificial Sequence
  Description of Artificial Sequence: Synthetic peptide
VRAAVPFDY

SEQ ID NO: 511 - protein, 12 aa, Artificial Sequence
  Description of Artificial Sequence: Synthetic peptide
GGSITSSSYYWG

SEQ ID NO: 512 - protein, 9 aa, Artificial Sequence
  Description of Artificial Sequence: Synthetic peptide
NIYYSGTTY

SEQ ID NO: 513 - protein, 7 aa, Artificial Sequence
  Description of Artificial Sequence: Synthetic peptide
GARDFDS

SEQ ID NO: 514 - protein, 9 aa, Artificial Sequence
  Description of Artificial Sequence: Synthetic peptide
VRPGIPFDY

SEQ ID NO: 515 - protein, 10 aa, Artificial Sequence
  Description of Artificial Sequence: Synthetic peptide
GFTFSSYAMH

SEQ ID NO: 516 - protein, 10 aa, Artificial Sequence
  Description of Artificial Sequence: Synthetic peptide
GISGSGFSTY

SEQ ID NO: 517 - protein, 11 aa, Artificial Sequence
  Description of Artificial Sequence: Synthetic peptide
DNLVAGTVFDY

SEQ ID NO: 518 - protein, 17 aa, Artificial Sequence
  Description of Artificial Sequence: Synthetic peptide
KSSQSVLHSSNNKNYLT

SEQ ID NO: 519 - protein, 7 aa, Artificial Sequence
  Description of Artificial Sequence: Synthetic peptide
WASTRES

SEQ ID NO: 520 - protein, 9 aa, Artificial Sequence
  Description of Artificial Sequence: Synthetic peptide
HQYYSTPPT

SEQ ID NO: 521 - protein, 17 aa, Artificial Sequence
  Description of Artificial Sequence: Synthetic peptide
KSSQSVLYSSKNKNYLA

SEQ ID NO: 522 - protein, 10 aa, Artificial Sequence
  Description of Artificial Sequence: Synthetic peptide
QQYYSTFPYT

SEQ ID NO: 523 - protein, 17 aa, Artificial Sequence
  Description of Artificial Sequence: Synthetic peptide
KSSQSVLFRSNNKNYLA

SEQ ID NO: 524 - protein, 9 aa, Artificial Sequence
  Description of Artificial Sequence: Synthetic peptide
QQYYSTPRT

SEQ ID NO: 525 - protein, 17 aa, Artificial Sequence
  Description of Artificial Sequence: Synthetic peptide
KSSQSVLFSSNNKNYLA

SEQ ID NO: 526 - protein, 9 aa, Artificial Sequence
  Description of Artificial Sequence: Synthetic peptide
QQYHSTPWT

SEQ ID NO: 527 - protein, 17 aa, Artificial Sequence
  Description of Artificial Sequence: Synthetic peptide
KSSQSVLYSSSNKSYLA

SEQ ID NO: 528 - protein, 11 aa, Artificial Sequence
  Description of Artificial Sequence: Synthetic peptide
QQYYSTPRMYT

SEQ ID NO: 529 - protein, 17 aa, Artificial Sequence
  Description of Artificial Sequence: Synthetic peptide
KSSQSVLFSSNKKNYLA

SEQ ID NO: 530 - protein, 9 aa, Artificial Sequence
  Description of Artificial Sequence: Synthetic peptide
QQYNSTPWT

SEQ ID NO: 531 - protein, 17 aa, Artificial Sequence
  Description of Artificial Sequence: Synthetic peptide
ESSQSVLFSSNKKNYLA

SEQ ID NO: 532 - protein, 11 aa, Artificial Sequence
  Description of Artificial Sequence: Synthetic peptide
RASQSISSWLA

SEQ ID NO: 533 - protein, 7 aa, Artificial Sequence
  Description of Artificial Sequence: Synthetic peptide
KASSLES

SEQ ID NO: 534 - protein, 9 aa, Artificial Sequence
  Description of Artificial Sequence: Synthetic peptide
QQYNSYSLT

SEQ ID NO: 535 - protein, 455 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITINPDTSKNQISLQLNSVTPEDTAVYYCAGDRRYGIVGLPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 536 - protein, 452 aa, Artificial Sequence
  Description of Artificial Sequence: Synthetic polypeptide
QVQLQQSGPGLVKPSQTLSLTCAISGDSVSNNSAAWNWIRQSPSRGLEWLGRTYYRSKWYNDYAVSVKSRITINPDTSKNQFSLQLNSVTPEDTAVYYCARYGSGTLLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 537 - protein, 455 aa, Artificial Sequence
  Description of Artificial Sequence: Synthetic polypeptide
QVQLQQSGPGLVRPSQTLSVTCAISGDSVSSNSASWNWIRQSPSRGLEWLGRTYYRSEWFNDYAVSVKSRVTINPDTSKNQLSLQLNSVIPEDTAVYYCAREARIGVAGKGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 538 - protein, 451 aa, Artificial Sequence
  Description of Artificial Sequence: Synthetic polypeptide
QVQLQQSGPGLVKPSQTLSLTCAISGDSVSSNRAAWNWIRQTPSRGLEWLGRTYYRSEWYNDYAVSVKSRITINPDTSKNQFSLQLNSVTPEDTAVYYCARVRAAVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 539 - protein, 447 aa, Artificial Sequence
  Description of Artificial Sequence: Synthetic polypeptide
QLQLQESGPGLVKPSETLSLMCTVSGGSITSSSYYWGWIRQPPGKGLEWIGNIYYSGTTYYNPSLKSRVTISVDTSKNQFSLKLSSVTAADTAVYYCAAGARDFDSWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 540 - protein, 451 aa, Artificial Sequence
  Description of Artificial Sequence: Synthetic polypeptide
EVQLLESGPGLVKPSQTLSLTCVISGDSVSSNRAAWNWIRQSPSRGLEWLGRTYYRSKWYNDYAVSVKSRITINSDTSKNQISLQLNSVTPEDTAVYYCARVRPGIPFDYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 541 - protein, 451 aa, Artificial Sequence
  Description of Artificial Sequence: Synthetic polypeptide
QVQLQQSGPGLVKPSQTLSLTCVISGDSVSSNRAAWNWIRQSPSRGLEWLGRTYYRSKWYNDYAVSVKSRITINSDTSKNQISLQLNSVTPEDTAVYYCARVRPGIPFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 542 - protein, 450 aa, Artificial Sequence
  Description of Artificial Sequence: Synthetic polypeptide
EVQLLESGGGLVQPGGSLRLSCAASGFTFSSYAMHWVRQAPGKGLDWVSGISGSGFSTYYVDSVKGRFTISRDNSKHTLYLQMNSLRAEDTAVYYCAKDNLVAGTVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 543 - protein, 454 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITINPDTSKNQISLQLNSVTPEDTAVYYCAGDRRYGIVGLPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 544 - protein, 449 aa, Artificial Sequence
  Description of Artificial Sequence: Synthetic polypeptide
EVQLLESGGGLVQPGGSLRLSCAASGFTFSSYAMHWVRQAPGKGLEWVSGISGSGFSTYYVDSVKGRFTISRDNSKNTLYLQMNSLRAEDTAVYYCAKDNLVAGTVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 545 - protein, 450 aa, Artificial Sequence
  Description of Artificial Sequence: Synthetic polypeptide
QVQLQQSGPGLVKPSQTLSLTCAISGDSVSSNRAAWNWIRQSPSRGLEWLGRTYYRSKWYNDYAVSVKSRITINPDTSKNQISLQLNSVTPEDTAVYYCARVRPGIPFDYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 546 - protein, 220 aa, Artificial Sequence
  Description of Artificial Sequence: Synthetic polypeptide
DIVMTQSPDSLAVSLGERATINCKSSQSVLHSSNNKNYLTWFQQKPGQPPKLLIYWASTRESGVPDRFSGSGSGTDFTLTISSLQAEDVAVYYCHQYYSTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 547 - protein, 221 aa, Artificial Sequence
  Description of Artificial Sequence: Synthetic polypeptide
DIVMTQSPDSLAVSLGERATINCKSSQSVLYSSKNKNYLAWYQQKPGQPPKLLIYWASTRESGVPDRFSGSGSGTDFTLTISSLQAEDVAVYYCQQYYSTFPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 548 - protein, 220 aa, Artificial Sequence
  Description of Artificial Sequence: Synthetic polypeptide
DIVMTQSPDSLAVSLGERATINCKSSQSVLFRSNNKNYLAWFQQKPGQPPKLLIYWASTRESGVPDRFSGSGSGTDFTLTISSLQAEDVAVYYCQQYYSTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 549 - protein, 220 aa, Artificial Sequence
  Description of Artificial Sequence: Synthetic polypeptide
DIVMTQSPDSLAVSLGERATINCKSSQSVLFSSNNKNYLAWYQQKPGQPPNLLIYWASTRESGVPDRFSGSVSGTDFTLTISSLQAEDVAIYYCQQYHSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 550 - protein, 222 aa, Artificial Sequence
  Description of Artificial Sequence: Synthetic polypeptide
DIVMTQSPDSLAVSLGERATINCKSSQSVLYSSSNKSYLAWYQQRPGQPPKLLIYWASTRESGVPDRFSGSGSGTDFTLTISSLQAEDVAVYYCQQYYSTPRMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 551 - protein, 220 aa, Artificial Sequence
  Description of Artificial Sequence: Synthetic polypeptide
DIVMTQSPDSLAVSLGERATINCKSSQSVLFSSNKKNYLAWYQQKPGQPPKLLIYWASTRESGVPDRFSGSGSGTDFTLTISSLQAEDVAVYYCQQYNSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 552 - protein, 220 aa, Artificial Sequence
  Description of Artificial Sequence: Synthetic polypeptide
DIQMTQSPDSLAVSLGERATINCESSQSVLFSSNKKNYLAWYQQKPGQPPKLLIYWASTRESGVPDRFSGSGSGTDFTLTINRLQAEDVAVYYCQQYNSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 553 - protein, 214 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSGTEFTLTISSLQPDDFATYYCQQYNSYSLTFGGGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 554 - protein, 220 aa, Artificial Sequence; identical to SEQ ID NO: 546
  Description of Artificial Sequence: Synthetic polypeptide

SEQ ID NO: 555 - protein, 214 aa, Artificial Sequence; identical to SEQ ID NO: 553
  Description of Artificial Sequence: Synthetic polypeptide

SEQ ID NO: 556 - protein, 220 aa, Artificial Sequence
  Description of Artificial Sequence: Synthetic polypeptide
DIVMTQSPDSLAVSLGERATINCKSSQSVLFSSNNKNYLAWYQQKPGQPPKLLIYWASTRESGVPDRFSGSVSGTDFTLTISSLQAEDVAVYYCQQYHSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 557 - DNA, 1365 bp, Artificial Sequence
  Description of Artificial Sequence: Synthetic polynucleotide
caggtgcagctgcagcagagcggccctggactggtgaagcccagccagaccctgagcctgacctgcgctatcagcggcgatagcgtgagctccaacagcgccgcctggaactggatcaggcagagccctagcaggggcctggaatggctgggcaggacctactacaggagcaagtggtacaacgactacgccgtgtccgtgaagagcaggatcaccatcaaccccgacaccagcaagaaccagatcagcctgcagctgaacagcgtgacccccgaggacaccgccgtgtactactgcgccggcgacagaaggtacggcatcgtgggcctgcctttcgcctactggggccagggaaccctggtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 558 - DNA, 660 bp, Artificial Sequence
  Description of Artificial Sequence: Synthetic polynucleotide
gacatcgtgatgacccagagccccgatagcctggctgtgagcctgggcgagagagccaccatcaactgcaagagcagccagagcgtgctgcacagcagcaacaacaagaactacctgacctggttccagcagaagcccggccagcctcccaagctgctgatctactgggctagcaccagagagtccggcgtgcctgacaggttcagcggaagcggcagcggcaccgacttcaccctgaccatcagcagcctgcaggccgaggacgtggccgtgtactactgccaccagtactacagcaccccccctacctttggccagggcaccaaggtggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 559 - DNA, 1356 bp, Artificial Sequence
  Description of Artificial Sequence: Synthetic polynucleotide
caggtgcagctgcagcagagcggacccggcctggtgaaacccagccagaccctgagcctgacctgcgccatcagcggcgacagcgtgagcaacaacagcgccgcctggaactggatcaggcagagccccagcagaggcctggaatggctgggcaggacctactacaggagcaagtggtacaacgactacgccgtgagcgtgaagagcaggatcaccatcaaccccgacacctccaagaaccagttcagcctgcagctgaacagcgtgacccccgaggacaccgccgtgtactactgcgccaggtatggcagcggcaccctgctgttcgactactggggccagggcaccctggtgacagtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 560 - DNA, 663 bp, Artificial Sequence
  Description of Artificial Sequence: Synthetic polynucleotide
gacatcgtgatgacccagagccccgatagcctggctgtgagcctgggagagagggccaccatcaactgcaagagcagccagagcgtgctgtacagcagcaagaacaagaactacctggcctggtaccagcagaaacccggccagccccccaagctgctgatctactgggccagcacaagggaaagcggcgtgcccgacagattcagcggaagcggcagcggcaccgacttcaccctgaccatcagcagcctgcaggccgaggatgtggccgtgtactactgccagcagtactacagcaccttcccctacaccttcggccagggcaccaagctggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 561 - DNA, 1365 bp, Artificial Sequence
  Description of Artificial Sequence: Synthetic polynucleotide
caggtgcagctgcagcagagcggacccggactggtgagacccagccagaccctgagcgtgacctgcgccatcagcggcgacagcgtgagcagcaacagcgccagctggaactggatcaggcagagccccagcagaggcctggagtggctgggaaggacatactacaggagcgagtggttcaacgactacgccgtgagcgtgaagagcagggtgaccatcaaccccgacaccagcaagaaccagctgagcctgcagctgaacagcgtgatccccgaggacaccgccgtgtactactgcgccagagaggccagaatcggcgtggccggcaaaggcttcgactactggggccagggcaccctggtgacagtgtccagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 562 - DNA, 660 bp, Artificial Sequence
  Description of Artificial Sequence: Synthetic polynucleotide
gacatcgtgatgacccagagccctgactccctggctgtgagcctgggcgagagagccaccatcaactgcaagagcagccagagcgtgctgttcaggagcaacaacaagaactacctggcctggttccagcagaagcccggccagcctcccaagctgctgatctactgggccagcaccagagagagcggcgtgcccgatagatttagcggcagcggcagcggcaccgactttaccctgaccatcagctccctgcaggccgaggatgtggccgtgtactactgccagcagtactacagcacccccagaaccttcggccagggcaccaaggtggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 563 - DNA, 1353 bp, Artificial Sequence
  Description of Artificial Sequence: Synthetic polynucleotide
caggtgcagctgcagcagagcggacctggcctggtgaagcccagccagaccctgagcctgacatgcgccatcagcggcgacagcgtgagcagcaatagggccgcctggaactggatcaggcagacccctagcaggggcctggaatggctgggcaggacatactacaggagcgagtggtacaacgactacgccgtgtccgtgaagagcaggatcaccatcaaccccgacaccagcaagaaccagttcagcctgcagctgaacagcgtgacccccgaggacaccgccgtgtactactgcgccagagtgagagccgccgtgcctttcgactactggggccagggcaccctggtgacagtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 564 - DNA, 660 bp, Artificial Sequence
  Description of Artificial Sequence: Synthetic polynucleotide
gacatcgtgatgacccagagccccgatagcctggctgtgagcctgggcgagagggccaccatcaactgcaagagcagccagagcgtgctgttttccagcaacaacaagaactacctggcctggtaccagcagaaacccggccagccccccaacctgctgatctactgggccagcaccagagaaagcggcgtgcccgacaggtttagcggcagcgtgagcggcaccgacttcaccctgaccatcagcagcctgcaggccgaggacgtggccatctactactgccagcagtaccacagcaccccctggacattcggccagggcaccaaggtggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 565 - DNA, 1341 bp, Artificial Sequence
  Description of Artificial Sequence: Synthetic polynucleotide
cagctgcagctgcaggagagcggccctggactggtgaagcccagcgagaccctgagcctgatgtgcaccgtgagcggcggcagcatcaccagcagcagctactactggggatggatcagacagccccctggcaagggcctggagtggatcggcaacatctactacagcggcaccacctactacaaccccagcctgaagagcagggtgaccatcagcgtggacaccagcaagaaccagttcagcctgaagctgagcagcgtgacagctgccgacaccgccgtgtactactgtgccgccggagccagagacttcgacagctggggacagggcagcctggtgaccgtgtccagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 566 - DNA, 666 bp, Artificial Sequence
  Description of Artificial Sequence: Synthetic polynucleotide
gacatcgtgatgacccagagccctgatagcctggccgtgagcctgggagagagagccaccatcaactgcaagtcctcccagagcgtgctgtacagctccagcaacaagagctacctggcctggtaccagcagaggcccggacagcctcccaagctgctgatctactgggccagcaccagagagagcggcgtgcctgacaggtttagcggctccggctccggcaccgactttaccctgaccatcagcagcctgcaggccgaggatgtggccgtgtactactgccagcagtactacagcacccccaggatgtacaccttcggccagggcaccaagctggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 567 - DNA, 1353 bp, Artificial Sequence
  Description of Artificial Sequence: Synthetic polynucleotide
gaggtgcagctgttggagtcaggtccaggactggtgaagccctcgcagaccctctcactcacctgtgtcatctccggggacagtgtctctagcaacagagctgcttggaactggatcaggcagtccccatcgagaggccttgagtggctgggaaggacatactacaggtccaagtggtataatgattatgcagtatctgtgaaaagtcgaataaccatcaattcagacacatccaagaaccagatctccctgcagttgaactctgtgactcccgaggacacggctgtgtattactgtgcaagagtgagaccggggatcccatttgactactggggccagggaaccccggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 568 - DNA, 660 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttattcagctccaacaaaaagaactacttagcttggtaccagcagaaaccaggacagccccctaagctgctcatttactgggcatctacccgggaatccggggtccctgaccgattcagtggcagcgggtctgggacagatttcactctcaccatcagcagcctgcaggctgaagatgtggcagtttattactgtcagcaatataatagtactccgtggacgttcggccaagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 569 - DNA, 1353 bp, Artificial Sequence
  Description of Artificial Sequence: Synthetic polynucleotide
caggtacagctgcagcagtcaggtccaggactggtgaagccctcgcagaccctctcactcacctgtgtcatctccggggacagtgtctctagcaacagagctgcctggaactggatcaggcagtccccatcgagaggccttgagtggctgggaaggacatactacaggtccaagtggtataatgattatgcagtttctgtgaaaagtcgaataaccatcaattcagacacatccaagaaccagatctccctgcagttgaactctgtgactcccgaggacacggctgtgtattactgtgcaagagtgagaccggggatcccttttgactactggggccagggaaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 570 - DNA, 660 bp, Artificial Sequence
  Description of Artificial Sequence: Synthetic polynucleotide
gacatccagatgacccagtctccagactccctggctgtgtctctgggcgagagggccaccatcaactgcgagtccagccagagtgttttattcagctccaacaaaaagaactacttagcttggtaccagcagaaaccaggacagccccctaagctgctcatttactgggcatctacccgggaatccggggtccctgaccgattcagtggcagcgggtctgggacagatttcactctcaccatcaaccgcctgcaggctgaagatgtggcagtttattactgtcagcaatataatagtactccgtggacgttcggccaagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 571 - DNA, 1350 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgcactgggtccgccaggccccagggaaggggctggactgggtctcaggtattagtggtagtggctttagcacatactatgtagactccgtgaagggccggttcaccatctccagagacaattccaagcacacgctgtatctgcaaatgaacagcctgagagccgaggacacggccgtatattactgtgcgaaagataatttagtggctggtaccgtctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 572 - DNA, 642 bp, Artificial Sequence
  Description of Artificial Sequence: Synthetic polynucleotide
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattcgctcactttcggcggagggaccaaggtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 573 - DNA, 1362 bp, Artificial Sequence
  Description of Artificial Sequence: Synthetic polynucleotide
caagtacaactgcaacaaagtggtcctgggctcgtgaagccttcccagactctcagcctcacatgcgctataagtggggattctgtttcctcaaattcagcagcctggaattggatacgacagtctccatcccgtggccttgagtggcttggtagaacttattaccgatccaagtggtacaatgattacgccgtttcagtgaagtcccgcattactattaatcccgacacatctaagaatcaaatttcattgcaactgaatagcgtaacacccgaagatacagcagtttattattgtgcaggtgatcgacgctacggcatagtgggacttcctttcgcctattggggccaagggacactggtcactgtgtcatccgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaactgctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 574 - DNA, 660 bp, Artificial Sequence
  Description of Artificial Sequence: Synthetic polynucleotide
gacatcgtaatgacacagtcaccagattcattggcagttagtctgggtgaaagggcaacaatcaactgcaagtcttctcagagtgtactgcatagttctaacaataagaactaccttacctggtttcaacagaaaccaggtcagccccccaagttgctgatttactgggcaagcacccgcgaatccggcgttcccgatcgattttcaggttccgggagtgggaccgactttaccttgaccatctcttccttgcaggccgaagatgtagccgtctattactgccatcagtattactctactccccccacattcggtcaaggtacaaaagttgagataaaacggacagtggccgctccttccgtgttcatcttcccaccttccgacgagcagctgaagtccggcacagcttctgtcgtgtgcctgctgaacaacttctaccctcgggaagccaaggtgcagtggaaggtggacaatgccctgcagtccggcaactcccaagagtctgtgaccgagcaggactccaaggacagcacctacagcctgtcctccacactgaccctgtccaaggccgactacgagaagcacaaggtgtacgcctgcgaagtgacccatcagggcctgtctagccctgtgaccaagtctttcaaccggggcgagtgt

SEQ ID NO: 575 - DNA, 1347 bp, Artificial Sequence
  Description of Artificial Sequence: Synthetic polynucleotide
gaggtgcaactccttgaatcaggcggaggactcgtccaacctggagggagtcttaggcttagctgtgcagccagtggctttacttttagcagctatgcaatgcactgggtcaggcaggctcctggtaaggggctcgaatgggtcagcggcatatccgggtcaggtttctctacatattatgtcgattctgtaaaaggacgattcaccatatccagagacaattctaaaaataccttgtatctccagatgaacagcctgagagcagaagataccgcagtttattactgtgcaaaggataatctggttgccgggacagtttttgattattgggggcaaggcaccctcgtcacagtatccagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaactgctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 576 - DNA, 642 bp, Artificial Sequence
  Description of Artificial Sequence: Synthetic polynucleotide
gatattcagatgactcaatcaccttcaacccttagcgcctccgttggagatcgcgttaccattacctgccgagcctcccaaagtatcagctcatggttggcatggtatcaacagaagcctggaaaggcacccaaacttctgatttacaaagccagctccttggagtcaggagtcccaagccggttcagcggatctgggtcagggacagaatttaccctgaccatatcttcccttcagcccgacgacttcgccacttactattgtcagcaatacaactcctattccctgactttcggcggtggcacaaaggttgacatcaagcggacagtggccgctccttccgtgttcatcttcccaccttccgacgagcagctgaagtccggcacagcttctgtcgtgtgcctgctgaacaacttctaccctcgggaagccaaggtgcagtggaaggtggacaatgccctgcagtccggcaactcccaagagtctgtgaccgagcaggactccaaggacagcacctacagcctgtcctccacactgaccctgtccaaggccgactacgagaagcacaaggtgtacgcctgcgaagtgacccatcagggcctgtctagccctgtgaccaagtctttcaaccggggcgagtgt

SEQ ID NO: 577 - DNA, 1350 bp, Artificial Sequence
  Description of Artificial Sequence: Synthetic polynucleotide
caggtgcagcttcaacagagcggacctggtctggttaagccttcccaaaccctgagcctgacttgtgctatttccggggatagtgttagctccaatagggcagcatggaactggatcagacagtccccaagccgtggacttgagtggcttggacgtacttattacaggagtaaatggtacaatgattatgccgtttctgtgaagagccgtattactataaacccagatacttctaaaaatcaaatttcccttcagctcaactcagttacaccagaggatactgcagtctattattgcgcaagagttcgacctggcattcccttcgattattgggggcaggggacacccgttactgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaactgctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 578 - DNA, 660 bp, Artificial Sequence
  Description of Artificial Sequence: Synthetic polynucleotide
gatattgttatgacacagtccccagattcattggcagtaagcctcggtgaacgggctactattaactgtaagtcttcccagagtgtattgttctcttcaaataacaaaaactacctggcatggtatcagcaaaagcctggtcaaccccctaaacttctcatatactgggcatccactcgggagagcggtgtgccagaccgtttctcagggagtgtgtcaggtacagattttacactcacaatttccagcctccaagccgaagacgttgcagtatattattgccaacaatatcactctacaccttggacatttggtcaaggtactaaagtcgaaatcaaacggacagtggccgctccttccgtgttcatcttcccaccttccgacgagcagctgaagtccggcacagcttctgtcgtgtgcctgctgaacaacttctaccctcgggaagccaaggtgcagtggaaggtggacaatgccctgcagtccggcaactcccaagagtctgtgaccgagcaggactccaaggacagcacctacagcctgtcctccacactgaccctgtccaaggccgactacgagaagcacaaggtgtacgcctgcgaagtgacccatcagggcctgtctagccctgtgaccaagtctttcaaccggggcgagtgt

SEQ ID NO: 579 - protein, 258 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITINPDTSKNQISLQLNSVTPEDTAVYYCAGDRRYGIVGLPFAYWGQGTLVTVSSGGSEGKSSGSGSESKSTGGSDIVMTQSPDSLAVSLGERATINCKSSQSVLHSSNNKNYLTWFQQKPGQPPKLLIYWASTRESGVPDRFSGSGSGTDFTLTISSLQAEDVAVYYCHQYYSTPPTFGQGTKVEIK

SEQ ID NO: 580 - protein, 258 aa, Artificial Sequence
  Description of Artificial Sequence: Synthetic polypeptide
DIVMTQSPDSLAVSLGERATINCKSSQSVLHSSNNKNYLTWFQQKPGQPPKLLIYWASTRESGVPDRFSGSGSGTDFTLTISSLQAEDVAVYYCHQYYSTPPTFGQGTKVEIKGGSEGKSSGSGSESKSTGGSQVQLQQSGPGLVKPSQTLSLTCAISGDSVSSNSAAWNWIRQSPSRGLEWLGRTYYRSKWYNDYAVSVKSRITINPDTSKNQISLQLNSVTPEDTAVYYCAGDRRYGIVGLPFAYWGQGTLVTVSS

SEQ ID NO: 581 - protein, 256 aa, Artificial Sequence
  Description of Artificial Sequence: Synthetic polypeptide
QVQLQQSGPGLVKPSQTLSLTCAISGDSVSNNSAAWNWIRQSPSRGLEWLGRTYYRSKWYNDYAVSVKSRITINPDTSKNQFSLQLNSVTPEDTAVYYCARYGSGTLLFDYWGQGTLVTVSSGGSEGKSSGSGSESKSTGGSDIVMTQSPDSLAVSLGERATINCKSSQSVLYSSKNKNYLAWYQQKPGQPPKLLIYWASTRESGVPDRFSGSGSGTDFTLTISSLQAEDVAVYYCQQYYSTFPYTFGQGTKLEIK

SEQ ID NO: 582 - protein, 256 aa, Artificial Sequence
  Description of Artificial Sequence: Synthetic polypeptide
DIVMTQSPDSLAVSLGERATINCKSSQSVLYSSKNKNYLAWYQQKPGQPPKLLIYWASTRESGVPDRFSGSGSGTDFTLTISSLQAEDVAVYYCQQYYSTFPYTFGQGTKLEIKGGSEGKSSGSGSESKSTGGSQVQLQQSGPGLVKPSQTLSLTCAISGDSVSNNSAAWNWIRQSPSRGLEWLGRTYYRSKWYNDYAVSVKSRITINPDTSKNQFSLQLNSVTPEDTAVYYCARYGSGTLLFDYWGQGTLVTVSS

SEQ ID NO: 583 - protein, 258 aa, Artificial Sequence
  Description of Artificial Sequence: Synthetic polypeptide
QVQLQQSGPGLVRPSQTLSVTCAISGDSVSSNSASWNWIRQSPSRGLEWLGRTYYRSEWFNDYAVSVKSRVTINPDTSKNQLSLQLNSVIPEDTAVYYCAREARIGVAGKGFDYWGQGTLVTVSSGGSEGKSSGSGSESKSTGGSDIVMTQSPDSLAVSLGERATINCKSSQSVLFRSNNKNYLAWFQQKPGQPPKLLIYWASTRESGVPDRFSGSGSGTDFTLTISSLQAEDVAVYYCQQYYSTPRTFGQGTKVEIK

SEQ ID NO: 584 - protein, 258 aa, Artificial Sequence
  Description of Artificial Sequence: Synthetic polypeptide
DIVMTQSPDSLAVSLGERATINCKSSQSVLFRSNNKNYLAWFQQKPGQPPKLLIYWASTRESGVPDRFSGSGSGTDFTLTISSLQAEDVAVYYCQQYYSTPRTFGQGTKVEIKGGSEGKSSGSGSESKSTGGSQVQLQQSGPGLVRPSQTLSVTCAISGDSVSSNSASWNWIRQSPSRGLEWLGRTYYRSEWFNDYAVSVKSRVTINPDTSKNQLSLQLNSVIPEDTAVYYCAREARIGVAGKGFDYWGQGTLVTVSS

SEQ ID NO: 585 - protein, 254 aa, Artificial Sequence
  Description of Artificial Sequence: Synthetic polypeptide
QVQLQQSGPGLVKPSQTLSLTCAISGDSVSSNRAAWNWIRQTPSRGLEWLGRTYYRSEWYNDYAVSVKSRITINPDTSKNQFSLQLNSVTPEDTAVYYCARVRAAVPFDYWGQGTLVTVSSGGSEGKSSGSGSESKSTGGSDIVMTQSPDSLAVSLGERATINCKSSQSVLFSSNNKNYLAWYQQKPGQPPNLLIYWASTRESGVPDRFSGSVSGTDFTLTISSLQAEDVAIYYCQQYHSTPWTFGQGTKVEIK

SEQ ID NO: 586 - protein, 254 aa, Artificial Sequence
  Description of Artificial Sequence: Synthetic polypeptide
DIVMTQSPDSLAVSLGERATINCKSSQSVLFSSNNKNYLAWYQQKPGQPPNLLIYWASTRESGVPDRFSGSVSGTDFTLTISSLQAEDVAIYYCQQYHSTPWTFGQGTKVEIKGGSEGKSSGSGSESKSTGGSQVQLQQSGPGLVKPSQTLSLTCAISGDSVSSNRAAWNWIRQTPSRGLEWLGRTYYRSEWYNDYAVSVKSRITINPDTSKNQFSLQLNSVTPEDTAVYYCARVRAAVPFDYWGQGTLVTVSS

SEQ ID NO: 587 - protein, 252 aa, Artificial Sequence
  Description of Artificial Sequence: Synthetic polypeptide
QLQLQESGPGLVKPSETLSLMCTVSGGSITSSSYYWGWIRQPPGKGLEWIGNIYYSGTTYYNPSLKSRVTISVDTSKNQFSLKLSSVTAADTAVYYCAAGARDFDSWGQGSLVTVSSGGSEGKSSGSGSESKSTGGSDIVMTQSPDSLAVSLGERATINCKSSQSVLYSSSNKSYLAWYQQRPGQPPKLLIYWASTRESGVPDRFSGSGSGTDFTLTISSLQAEDVAVYYCQQYYSTPRMYTFGQGTKLEIK

SEQ ID NO: 588 - protein, 252 aa, Artificial Sequence
  Description of Artificial Sequence: Synthetic polypeptide
DIVMTQSPDSLAVSLGERATINCKSSQSVLYSSSNKSYLAWYQQRPGQPPKLLIYWASTRESGVPDRFSGSGSGTDFTLTISSLQAEDVAVYYCQQYYSTPRMYTFGQGTKLEIKGGSEGKSSGSGSESKSTGGSQLQLQESGPGLVKPSETLSLMCTVSGGSITSSSYYWGWIRQPPGKGLEWIGNIYYSGTTYYNPSLKSRVTISVDTSKNQFSLKLSSVTAADTAVYYCAAGARDFDSWGQGSLVTVSS

SEQ ID NO: 589 - protein, 254 aa, Artificial Sequence
  Description of Artificial Sequence: Synthetic polypeptide
EVQLLESGPGLVKPSQTLSLTCVISGDSVSSNRAAWNWIRQSPSRGLEWLGRTYYRSKWYNDYAVSVKSRITINSDTSKNQISLQLNSVTPEDTAVYYCARVRPGIPFDYWGQGTPVTVSSGGSEGKSSGSGSESKSTGGSDIVMTQSPDSLAVSLGERATINCKSSQSVLFSSNKKNYLAWYQQKPGQPPKLLIYWASTRESGVPDRFSGSGSGTDFTLTISSLQAEDVAVYYCQQYNSTPWTFGQGTKVEIK

SEQ ID NO: 590 - protein, 254 aa, Artificial Sequence
  Description of Artificial Sequence: Synthetic polypeptide
DIVMTQSPDSLAVSLGERATINCKSSQSVLFSSNKKNYLAWYQQKPGQPPKLLIYWASTRESGVPDRFSGSGSGTDFTLTISSLQAEDVAVYYCQQYNSTPWTFGQGTKVEIKGGSEGKSSGSGSESKSTGGSEVQLLESGPGLVKPSQTLSLTCVISGDSVSSNRAAWNWIRQSPSRGLEWLGRTYYRSKWYNDYAVSVKSRITINSDTSKNQISLQLNSVTPEDTAVYYCARVRPGIPFDYWGQGTPVTVSS

SEQ ID NO: 591 - protein, 254 aa, Artificial Sequence
  Description of Artificial Sequence: Synthetic polypeptide
QVQLQQSGPGLVKPSQTLSLTCVISGDSVSSNRAAWNWIRQSPSRGLEWLGRTYYRSKWYNDYAVSVKSRITINSDTSKNQISLQLNSVTPEDTAVYYCARVRPGIPFDYWGQGTTVTVSSGGSEGKSSGSGSESKSTGGSDIQMTQSPDSLAVSLGERATINCESSQSVLFSSNKKNYLAWYQQKPGQPPKLLIYWASTRESGVPDRFSGSGSGTDFTLTINRLQAEDVAVYYCQQYNSTPWTFGQGTKVEIK

SEQ ID NO: 592 - protein, 254 aa, Artificial Sequence
  Description of Artificial Sequence: Synthetic polypeptide
DIQMTQSPDSLAVSLGERATINCESSQSVLFSSNKKNYLAWYQQKPGQPPKLLIYWASTRESGVPDRFSGSGSGTDFTLTINRLQAEDVAVYYCQQYNSTPWTFGQGTKVEIKGGSEGKSSGSGSESKSTGGSQVQLQQSGPGLVKPSQTLSLTCVISGDSVSSNRAAWNWIRQSPSRGLEWLGRTYYRSKWYNDYAVSVKSRITINSDTSKNQISLQLNSVTPEDTAVYYCARVRPGIPFDYWGQGTTVTVSS

SEQ ID NO: 593 - protein, 247 aa, Artificial Sequence
  Description of Artificial Sequence: Synthetic polypeptide
EVQLLESGGGLVQPGGSLRLSCAASGFTFSSYAMHWVRQAPGKGLDWVSGISGSGFSTYYVDSVKGRFTISRDNSKHTLYLQMNSLRAEDTAVYYCAKDNLVAGTVFDYWGQGTLVTVSSGGSEGKSSGSGSESKSTGGSDIQMTQSPSTLSASVGDRVTITCRASQSISSWLAWYQQKPGKAPKLLIYKASSLESGVPSRFSGSGSGTEFTLTISSLQPDDFATYYCQQYNSYSLTFGGGTKVDIK

SEQ ID NO: 594 - protein, 247 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSGTEFTLTISSLQPDDFATYYCQQYNSYSLTFGGGTKVDIKGGSEGKSSGSGSESKSTGGSEVQLLESGGGLVQPGGSLRLSCAASGFTFSSYAMHWVRQAPGKGLDWVSGISGSGFSTYYVDSVKGRFTISRDNSKHTLYLQMNSLRAEDTAVYYCAKDNLVAGTVFDYWGQGTLVTVSS

SEQ ID NO: 595 - protein, 258 aa, Artificial Sequence; identical to SEQ ID NO: 579
  Description of Artificial Sequence: Synthetic polypeptide

SEQ ID NO: 596 - protein, 258 aa, Artificial Sequence; identical to SEQ ID NO: 580
  Description of Artificial Sequence: Synthetic polypeptide

SEQ ID NO: 597 - protein, 247 aa, Artificial Sequence
  Description of Artificial Sequence: Synthetic polypeptide
EVQLLESGGGLVQPGGSLRLSCAASGFTFSSYAMHWVRQAPGKGLEWVSGISGSGFSTYYVDSVKGRFTISRDNSKNTLYLQMNSLRAEDTAVYYCAKDNLVAGTVFDYWGQGTLVTVSSGGSEGKSSGSGSESKSTGGSDIQMTQSPSTLSASVGDRVTITCRASQSISSWLAWYQQKPGKAPKLLIYKASSLESGVPSRFSGSGSGTEFTLTISSLQPDDFATYYCQQYNSYSLTFGGGTKVDIK

SEQ ID NO: 598 - protein, 247 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSGTEFTLTISSLQPDDFATYYCQQYNSYSLTFGGGTKVDIKGGSEGKSSGSGSESKSTGGSEVQLLESGGGLVQPGGSLRLSCAASGFTFSSYAMHWVRQAPGKGLEWVSGISGSGFSTYYVDSVKGRFTISRDNSKNTLYLQMNSLRAEDTAVYYCAKDNLVAGTVFDYWGQGTLVTVSS

SEQ ID NO: 599 - protein, 254 aa, Artificial Sequence
  Description of Artificial Sequence: Synthetic polypeptide
QVQLQQSGPGLVKPSQTLSLTCAISGDSVSSNRAAWNWIRQSPSRGLEWLGRTYYRSKWYNDYAVSVKSRITINPDTSKNQISLQLNSVTPEDTAVYYCARVRPGIPFDYWGQGTPVTVSSGGSEGKSSGSGSESKSTGGSDIVMTQSPDSLAVSLGERATINCKSSQSVLFSSNNKNYLAWYQQKPGQPPKLLIYWASTRESGVPDRFSGSVSGTDFTLTISSLQAEDVAVYYCQQYHSTPWTFGQGTKVEIK

SEQ ID NO: 600 - protein, 254 aa, Artificial Sequence
  Description of Artificial Sequence: Synthetic polypeptide
DIVMTQSPDSLAVSLGERATINCKSSQSVLFSSNNKNYLAWYQQKPGQPPKLLIYWASTRESGVPDRFSGSVSGTDFTLTISSLQAEDVAVYYCQQYHSTPWTFGQGTKVEIKGGSEGKSSGSGSESKSTGGSQVQLQQSGPGLVKPSQTLSLTCAISGDSVSSNRAAWNWIRQSPSRGLEWLGRTYYRSKWYNDYAVSVKSRITINPDTSKNQISLQLNSVTPEDTAVYYCARVRPGIPFDYWGQGTPVTVSS

SEQ ID NO: 601 - protein, 490 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITINPDTSKNQISLQLNSVTPEDTAVYYCAGDRRYGIVGLPFAYWGQGTLVTVSSGGSEGKSSGSGSESKSTGGSDIVMTQSPDSLAVSLGERATINCKSSQSVLHSSNNKNYLTWFQQKPGQPPKLLIYWASTRESGVPDRFSGSGSGTDFTLTISSLQAEDVAVYYCHQYYSTPPTFGQGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 602 - protein, 490 aa, Artificial Sequence
  Description of Artificial Sequence: Synthetic polypeptide
DIVMTQSPDSLAVSLGERATINCKSSQSVLHSSNNKNYLTWFQQKPGQPPKLLIYWASTRESGVPDRFSGSGSGTDFTLTISSLQAEDVAVYYCHQYYSTPPTFGQGTKVEIKGGSEGKSSGSGSESKSTGGSQVQLQQSGPGLVKPSQTLSLTCAISGDSVSSNSAAWNWIRQSPSRGLEWLGRTYYRSKWYNDYAVSVKSRITINPDTSKNQISLQLNSVTPEDTAVYYCAGDRRYGIVGLPFAYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 603 - protein, 488 aa, Artificial Sequence
  Description of Artificial Sequence: Synthetic polypeptide
QVQLQQSGPGLVKPSQTLSLTCAISGDSVSNNSAAWNWIRQSPSRGLEWLGRTYYRSKWYNDYAVSVKSRITINPDTSKNQFSLQLNSVTPEDTAVYYCARYGSGTLLFDYWGQGTLVTVSSGGSEGKSSGSGSESKSTGGSDIVMTQSPDSLAVSLGERATINCKSSQSVLYSSKNKNYLAWYQQKPGQPPKLLIYWASTRESGVPDRFSGSGSGTDFTLTISSLQAEDVAVYYCQQYYSTFPYTFGQGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 604 - protein, 488 aa, Artificial Sequence
  Description of Artificial Sequence: Synthetic polypeptide
DIVMTQSPDSLAVSLGERATINCKSSQSVLYSSKNKNYLAWYQQKPGQPPKLLIYWASTRESGVPDRFSGSGSGTDFTLTISSLQAEDVAVYYCQQYYSTFPYTFGQGTKLEIKGGSEGKSSGSGSESKSTGGSQVQLQQSGPGLVKPSQTLSLTCAISGDSVSNNSAAWNWIRQSPSRGLEWLGRTYYRSKWYNDYAVSVKSRITINPDTSKNQFSLQLNSVTPEDTAVYYCARYGSGTLLFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 605 - protein, 490 aa, Artificial Sequence
  Description of Artificial Sequence: Synthetic polypeptide
QVQLQQSGPGLVRPSQTLSVTCAISGDSVSSNSASWNWIRQSPSRGLEWLGRTYYRSEWFNDYAVSVKSRVTINPDTSKNQLSLQLNSVIPEDTAVYYCAREARIGVAGKGFDYWGQGTLVTVSSGGSEGKSSGSGSESKSTGGSDIVMTQSPDSLAVSLGERATINCKSSQSVLFRSNNKNYLAWFQQKPGQPPKLLIYWASTRESGVPDRFSGSGSGTDFTLTISSLQAEDVAVYYCQQYYSTPRTFGQGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 606 - protein, 490 aa, Artificial Sequence
  Description of Artificial Sequence: Synthetic polypeptide
DIVMTQSPDSLAVSLGERATINCKSSQSVLFRSNNKNYLAWFQQKPGQPPKLLIYWASTRESGVPDRFSGSGSGTDFTLTISSLQAEDVAVYYCQQYYSTPRTFGQGTKVEIKGGSEGKSSGSGSESKSTGGSQVQLQQSGPGLVRPSQTLSVTCAISGDSVSSNSASWNWIRQSPSRGLEWLGRTYYRSEWFNDYAVSVKSRVTINPDTSKNQLSLQLNSVIPEDTAVYYCAREARIGVAGKGFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 607 - protein, 486 aa, Artificial Sequence
  Description of Artificial Sequence: Synthetic polypeptide
QVQLQQSGPGLVKPSQTLSLTCAISGDSVSSNRAAWNWIRQTPSRGLEWLGRTYYRSEWYNDYAVSVKSRITINPDTSKNQFSLQLNSVTPEDTAVYYCARVRAAVPFDYWGQGTLVTVSSGGSEGKSSGSGSESKSTGGSDIVMTQSPDSLAVSLGERATINCKSSQSVLFSSNNKNYLAWYQQKPGQPPNLLIYWASTRESGVPDRFSGSVSGTDFTLTISSLQAEDVAIYYCQQYHSTPWTFGQGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 608 - protein, 486 aa, Artificial Sequence
  Description of Artificial Sequence: Synthetic polypeptide
DIVMTQSPDSLAVSLGERATINCKSSQSVLFSSNNKNYLAWYQQKPGQPPNLLIYWASTRESGVPDRFSGSVSGTDFTLTISSLQAEDVAIYYCQQYHSTPWTFGQGTKVEIKGGSEGKSSGSGSESKSTGGSQVQLQQSGPGLVKPSQTLSLTCAISGDSVSSNRAAWNWIRQTPSRGLEWLGRTYYRSEWYNDYAVSVKSRITINPDTSKNQFSLQLNSVTPEDTAVYYCARVRAAVPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 609 - protein, 484 aa, Artificial Sequence
  Description of Artificial Sequence: Synthetic polypeptide
QLQLQESGPGLVKPSETLSLMCTVSGGSITSSSYYWGWIRQPPGKGLEWIGNIYYSGTTYYNPSLKSRVTISVDTSKNQFSLKLSSVTAADTAVYYCAAGARDFDSWGQGSLVTVSSGGSEGKSSGSGSESKSTGGSDIVMTQSPDSLAVSLGERATINCKSSQSVLYSSSNKSYLAWYQQRPGQPPKLLIYWASTRESGVPDRFSGSGSGTDFTLTISSLQAEDVAVYYCQQYYSTPRMYTFGQGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 610 - protein, 484 aa, Artificial Sequence
  Description of Artificial Sequence: Synthetic polypeptide
DIVMTQSPDSLAVSLGERATINCKSSQSVLYSSSNKSYLAWYQQRPGQPPKLLIYWASTRESGVPDRFSGSGSGTDFTLTISSLQAEDVAVYYCQQYYSTPRMYTFGQGTKLEIKGGSEGKSSGSGSESKSTGGSQLQLQESGPGLVKPSETLSLMCTVSGGSITSSSYYWGWIRQPPGKGLEWIGNIYYSGTTYYNPSLKSRVTISVDTSKNQFSLKLSSVTAADTAVYYCAAGARDFDSWGQGSLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 611 - protein, 486 aa, Artificial Sequence
  Description of Artificial Sequence: Synthetic polypeptide
EVQLLESGPGLVKPSQTLSLTCVISGDSVSSNRAAWNWIRQSPSRGLEWLGRTYYRSKWYNDYAVSVKSRITINSDTSKNQISLQLNSVTPEDTAVYYCARVRPGIPFDYWGQGTPVTVSSGGSEGKSSGSGSESKSTGGSDIVMTQSPDSLAVSLGERATINCKSSQSVLFSSNKKNYLAWYQQKPGQPPKLLIYWASTRESGVPDRFSGSGSGTDFTLTISSLQAEDVAVYYCQQYNSTPWTFGQGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 612 - protein, 486 aa, Artificial Sequence
  Description of Artificial Sequence: Synthetic polypeptide
DIVMTQSPDSLAVSLGERATINCKSSQSVLFSSNKKNYLAWYQQKPGQPPKLLIYWASTRESGVPDRFSGSGSGTDFTLTISSLQAEDVAVYYCQQYNSTPWTFGQGTKVEIKGGSEGKSSGSGSESKSTGGSEVQLLESGPGLVKPSQTLSLTCVISGDSVSSNRAAWNWIRQSPSRGLEWLGRTYYRSKWYNDYAVSVKSRITINSDTSKNQISLQLNSVTPEDTAVYYCARVRPGIPFDYWGQGTPVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 613 - protein, 486 aa, Artificial Sequence
  Description of Artificial Sequence: Synthetic polypeptide
QVQLQQSGPGLVKPSQTLSLTCVISGDSVSSNRAAWNWIRQSPSRGLEWLGRTYYRSKWYNDYAVSVKSRITINSDTSKNQISLQLNSVTPEDTAVYYCARVRPGIPFDYWGQGTTVTVSSGGSEGKSSGSGSESKSTGGSDIQMTQSPDSLAVSLGERATINCESSQSVLFSSNKKNYLAWYQQKPGQPPKLLIYWASTRESGVPDRFSGSGSGTDFTLTINRLQAEDVAVYYCQQYNSTPWTFGQGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 614 - protein, 486 aa, Artificial Sequence
  Description of Artificial Sequence: Synthetic polypeptide
DIQMTQSPDSLAVSLGERATINCESSQSVLFSSNKKNYLAWYQQKPGQPPKLLIYWASTRESGVPDRFSGSGSGTDFTLTINRLQAEDVAVYYCQQYNSTPWTFGQGTKVEIKGGSEGKSSGSGSESKSTGGSQVQLQQSGPGLVKPSQTLSLTCVISGDSVSSNRAAWNWIRQSPSRGLEWLGRTYYRSKWYNDYAVSVKSRITINSDTSKNQISLQLNSVTPEDTAVYYCARVRPGIPFDYWGQGTTVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 615 - protein, 479 aa, Artificial Sequence
  Description of Artificial Sequence: Synthetic polypeptide
EVQLLESGGGLVQPGGSLRLSCAASGFTFSSYAMHWVRQAPGKGLDWVSGISGSGFSTYYVDSVKGRFTISRDNSKHTLYLQMNSLRAEDTAVYYCAKDNLVAGTVFDYWGQGTLVTVSSGGSEGKSSGSGSESKSTGGSDIQMTQSPSTLSASVGDRVTITCRASQSISSWLAWYQQKPGKAPKLLIYKASSLESGVPSRFSGSGSGTEFTLTISSLQPDDFATYYCQQYNSYSLTFGGGTKVDIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 616 - protein, 479 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSGTEFTLTISSLQPDDFATYYCQQYNSYSLTFGGGTKVDIKGGSEGKSSGSGSESKSTGGSEVQLLESGGGLVQPGGSLRLSCAASGFTFSSYAMHWVRQAPGKGLDWVSGISGSGFSTYYVDSVKGRFTISRDNSKHTLYLQMNSLRAEDTAVYYCAKDNLVAGTVFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 617 - protein, 490 aa, Artificial Sequence; identical to SEQ ID NO: 601
  Description of Artificial Sequence: Synthetic polypeptide

SEQ ID NO: 618 - protein, 490 aa, Artificial Sequence; identical to SEQ ID NO: 602
  Description of Artificial Sequence: Synthetic polypeptide

SEQ ID NO: 619 - protein, 479 aa, Artificial Sequence
  Description of Artificial Sequence: Synthetic polypeptide
EVQLLESGGGLVQPGGSLRLSCAASGFTFSSYAMHWVRQAPGKGLEWVSGISGSGFSTYYVDSVKGRFTISRDNSKNTLYLQMNSLRAEDTAVYYCAKDNLVAGTVFDYWGQGTLVTVSSGGSEGKSSGSGSESKSTGGSDIQMTQSPSTLSASVGDRVTITCRASQSISSWLAWYQQKPGKAPKLLIYKASSLESGVPSRFSGSGSGTEFTLTISSLQPDDFATYYCQQYNSYSLTFGGGTKVDIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 620 - protein, 479 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSGTEFTLTISSLQPDDFATYYCQQYNSYSLTFGGGTKVDIKGGSEGKSSGSGSESKSTGGSEVQLLESGGGLVQPGGSLRLSCAASGFTFSSYAMHWVRQAPGKGLEWVSGISGSGFSTYYVDSVKGRFTISRDNSKNTLYLQMNSLRAEDTAVYYCAKDNLVAGTVFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 621 - protein, 486 aa, Artificial Sequence
  Description of Artificial Sequence: Synthetic polypeptide
QVQLQQSGPGLVKPSQTLSLTCAISGDSVSSNRAAWNWIRQSPSRGLEWLGRTYYRSKWYNDYAVSVKSRITINPDTSKNQISLQLNSVTPEDTAVYYCARVRPGIPFDYWGQGTPVTVSSGGSEGKSSGSGSESKSTGGSDIVMTQSPDSLAVSLGERATINCKSSQSVLFSSNNKNYLAWYQQKPGQPPKLLIYWASTRESGVPDRFSGSVSGTDFTLTISSLQAEDVAVYYCQQYHSTPWTFGQGTKVEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 622 - protein, 486 aa, Artificial Sequence
  Description of Artificial Sequence: Synthetic polypeptide
DIVMTQSPDSLAVSLGERATINCKSSQSVLFSSNNKNYLAWYQQKPGQPPKLLIYWASTRESGVPDRFSGSVSGTDFTLTISSLQAEDVAVYYCQQYHSTPWTFGQGTKVEIKGGSEGKSSGSGSESKSTGGSQVQLQQSGPGLVKPSQTLSLTCAISGDSVSSNRAAWNWIRQSPSRGLEWLGRTYYRSKWYNDYAVSVKSRITINPDTSKNQISLQLNSVTPEDTAVYYCARVRPGIPFDYWGQGTPVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 623 - DNA, 774 bp, Artificial Sequence
  Description of Artificial Sequence: Synthetic polynucleotide
caggtgcagctgcagcagagcggccctggactggtgaagcccagccagaccctgagcctgacctgcgctatcagcggcgatagcgtgagctccaacagcgccgcctggaactggatcaggcagagccctagcaggggcctggaatggctgggcaggacctactacaggagcaagtggtacaacgactacgccgtgtccgtgaagagcaggatcaccatcaaccccgacaccagcaagaaccagatcagcctgcagctgaacagcgtgacccccgaggacaccgccgtgtactactgcgccggcgacagaaggtacggcatcgtgggcctgcctttcgcctactggggccagggaaccctggtgaccgtgagcagcggcggatctgagggaaagtccagcggctccggcagcgaaagcaagtccaccggcggaagcgacatcgtgatgacccagagccccgatagcctggctgtgagcctgggcgagagagccaccatcaactgcaagagcagccagagcgtgctgcacagcagcaacaacaagaactacctgacctggttccagcagaagcccggccagcctcccaagctgctgatctactgggctagcaccagagagtccggcgtgcctgacaggttcagcggaagcggcagcggcaccgacttcaccctgaccatcagcagcctgcaggccgaggacgtggccgtgtactactgccaccagtactacagcaccccccctacctttggccagggcaccaaggtggagatcaag

SEQ ID NO: 624 - DNA, 774 bp, Artificial Sequence
  Description of Artificial Sequence: Synthetic polynucleotide
gacatcgtgatgacccagagccccgatagcctggctgtgagcctgggcgagagagccaccatcaactgcaagagcagccagagcgtgctgcacagcagcaacaacaagaactacctgacctggttccagcagaagcccggccagcctcccaagctgctgatctactgggctagcaccagagagtccggcgtgcctgacaggttcagcggaagcggcagcggcaccgacttcaccctgaccatcagcagcctgcaggccgaggacgtggccgtgtactactgccaccagtactacagcaccccccctacctttggccagggcaccaaggtggagatcaagggcggatctgagggaaagtccagcggctccggcagcgaaagcaagtccaccggcggaagccaggtgcagctgcagcagagcggccctggactggtgaagcccagccagaccctgagcctgacctgcgctatcagcggcgatagcgtgagctccaacagcgccgcctggaactggatcaggcagagccctagcaggggcctggaatggctgggcaggacctactacaggagcaagtggtacaacgactacgccgtgtccgtgaagagcaggatcaccatcaaccccgacaccagcaagaaccagatcagcctgcagctgaacagcgtgacccccgaggacaccgccgtgtactactgcgccggcgacagaaggtacggcatcgtgggcctgcctttcgcctactggggccagggaaccctggtgaccgtgagcagc

SEQ ID NO: 625 - DNA, 768 bp, Artificial Sequence
  Description of Artificial Sequence: Synthetic polynucleotide
caggtgcagctgcagcagagcggacccggcctggtgaaacccagccagaccctgagcctgacctgcgccatcagcggcgacagcgtgagcaacaacagcgccgcctggaactggatcaggcagagccccagcagaggcctggaatggctgggcaggacctactacaggagcaagtggtacaacgactacgccgtgagcgtgaagagcaggatcaccatcaaccccgacacctccaagaaccagttcagcctgcagctgaacagcgtgacccccgaggacaccgccgtgtactactgcgccaggtatggcagcggcaccctgctgttcgactactggggccagggcaccctggtgacagtgagcagcggcggatctgagggaaagtccagcggctccggcagcgaaagcaagtccaccggcggaagcgacatcgtgatgacccagagccccgatagcctggctgtgagcctgggagagagggccaccatcaactgcaagagcagccagagcgtgctgtacagcagcaagaacaagaactacctggcctggtaccagcagaaacccggccagccccccaagctgctgatctactgggccagcacaagggaaagcggcgtgcccgacagattcagcggaagcggcagcggcaccgacttcaccctgaccatcagcagcctgcaggccgaggatgtggccgtgtactactgccagcagtactacagcaccttcccctacaccttcggccagggcaccaagctggagatcaag

SEQ ID NO: 626 - DNA, 768 bp, Artificial Sequence
  Description of Artificial Sequence: Synthetic polynucleotide
gacatcgtgatgacccagagccccgatagcctggctgtgagcctgggagagagggccaccatcaactgcaagagcagccagagcgtgctgtacagcagcaagaacaagaactacctggcctggtaccagcagaaacccggccagccccccaagctgctgatctactgggccagcacaagggaaagcggcgtgcccgacagattcagcggaagcggcagcggcaccgacttcaccctgaccatcagcagcctgcaggccgaggatgtggccgtgtactactgccagcagtactacagcaccttcccctacaccttcggccagggcaccaagctggagatcaagggcggatctgagggaaagtccagcggctccggcagcgaaagcaagtccaccggcggaagccaggtgcagctgcagcagagcggacccggcctggtgaaacccagccagaccctgagcctgacctgcgccatcagcggcgacagcgtgagcaacaacagcgccgcctggaactggatcaggcagagccccagcagaggcctggaatggctgggcaggacctactacaggagcaagtggtacaacgactacgccgtgagcgtgaagagcaggatcaccatcaaccccgacacctccaagaaccagttcagcctgcagctgaacagcgtgacccccgaggacaccgccgtgtactactgcgccaggtatggcagcggcaccctgctgttcgactactggggccagggcaccctggtgacagtgagcagc

SEQ ID NO: 627 - DNA, 774 bp, Artificial Sequence
  Description of Artificial Sequence: Synthetic polynucleotide
caggtgcagctgcagcagagcggacccggactggtgagacccagccagaccctgagcgtgacctgcgccatcagcggcgacagcgtgagcagcaacagcgccagctggaactggatcaggcagagccccagcagaggcctggagtggctgggaaggacatactacaggagcgagtggttcaacgactacgccgtgagcgtgaagagcagggtgaccatcaaccccgacaccagcaagaaccagctgagcctgcagctgaacagcgtgatccccgaggacaccgccgtgtactactgcgccagagaggccagaatcggcgtggccggcaaaggcttcgactactggggccagggcaccctggtgacagtgtccagcggcggatctgagggaaagtccagcggctccggcagcgaaagcaagtccaccggcggaagcgacatcgtgatgacccagagccctgactccctggctgtgagcctgggcgagagagccaccatcaactgcaagagcagccagagcgtgctgttcaggagcaacaacaagaactacctggcctggttccagcagaagcccggccagcctcccaagctgctgatctactgggccagcaccagagagagcggcgtgcccgatagatttagcggcagcggcagcggcaccgactttaccctgaccatcagctccctgcaggccgaggatgtggccgtgtactactgccagcagtactacagcacccccagaaccttcggccagggcaccaaggtggagatcaag

SEQ ID NO: 628 - DNA, 774 bp, Artificial Sequence
  Description of Artificial Sequence: Synthetic polynucleotide
gacatcgtgatgacccagagccctgactccctggctgtgagcctgggcgagagagccaccatcaactgcaagagcagccagagcgtgctgttcaggagcaacaacaagaactacctggcctggttccagcagaagcccggccagcctcccaagctgctgatctactgggccagcaccagagagagcggcgtgcccgatagatttagcggcagcggcagcggcaccgactttaccctgaccatcagctccctgcaggccgaggatgtggccgtgtactactgccagcagtactacagcacccccagaaccttcggccagggcaccaaggtggagatcaagggcggatctgagggaaagtccagcggctccggcagcgaaagcaagtccaccggcggaagccaggtgcagctgcagcagagcggacccggactggtgagacccagccagaccctgagcgtgacctgcgccatcagcggcgacagcgtgagcagcaacagcgccagctggaactggatcaggcagagccccagcagaggcctggagtggctgggaaggacatactacaggagcgagtggttcaacgactacgccgtgagcgtgaagagcagggtgaccatcaaccccgacaccagcaagaaccagctgagcctgcagctgaacagcgtgatccccgaggacaccgccgtgtactactgcgccagagaggccagaatcggcgtggccggcaaaggcttcgactactggggccagggcaccctggtgacagtgtccagc

SEQ ID NO: 629 - DNA, 762 bp, Artificial Sequence
  Description of Artificial Sequence: Synthetic polynucleotide
caggtgcagctgcagcagagcggacctggcctggtgaagcccagccagaccctgagcctgacatgcgccatcagcggcgacagcgtgagcagcaatagggccgcctggaactggatcaggcagacccctagcaggggcctggaatggctgggcaggacatactacaggagcgagtggtacaacgactacgccgtgtccgtgaagagcaggatcaccatcaaccccgacaccagcaagaaccagttcagcctgcagctgaacagcgtgacccccgaggacaccgccgtgtactactgcgccagagtgagagccgccgtgcctttcgactactggggccagggcaccctggtgacagtgagcagcggcggatctgagggaaagtccagcggctccggcagcgaaagcaagtccaccggcggaagcgacatcgtgatgacccagagccccgatagcctggctgtgagcctgggcgagagggccaccatcaactgcaagagcagccagagcgtgctgttttccagcaacaacaagaactacctggcctggtaccagcagaaacccggccagccccccaacctgctgatctactgggccagcaccagagaaagcggcgtgcccgacaggtttagcggcagcgtgagcggcaccgacttcaccctgaccatcagcagcctgcaggccgaggacgtggccatctactactgccagcagtaccacagcaccccctggacattcggccagggcaccaaggtggagatcaag

SEQ ID NO: 630 - DNA, 762 bp, Artificial Sequence
  Description of Artificial Sequence: Synthetic polynucleotide
gacatcgtgatgacccagagccccgatagcctggctgtgagcctgggcgagagggccaccatcaactgcaagagcagccagagcgtgctgttttccagcaacaacaagaactacctggcctggtaccagcagaaacccggccagccccccaacctgctgatctactgggccagcaccagagaaagcggcgtgcccgacaggtttagcggcagcgtgagcggcaccgacttcaccctgaccatcagcagcctgcaggccgaggacgtggccatctactactgccagcagtaccacagcaccccctggacattcggccagggcaccaaggtggagatcaagggcggatctgagggaaagtccagcggctccggcagcgaaagcaagtccaccggcggaagccaggtgcagctgcagcagagcggacctggcctggtgaagcccagccagaccctgagcctgacatgcgccatcagcggcgacagcgtgagcagcaatagggccgcctggaactggatcaggcagacccctagcaggggcctggaatggctgggcaggacatactacaggagcgagtggtacaacgactacgccgtgtccgtgaagagcaggatcaccatcaaccccgacaccagcaagaaccagttcagcctgcagctgaacagcgtgacccccgaggacaccgccgtgtactactgcgccagagtgagagccgccgtgcctttcgactactggggccagggcaccctggtgacagtgagcagc

SEQ ID NO: 631 - DNA, 756 bp, Artificial Sequence
  Description of Artificial Sequence: Synthetic polynucleotide
cagctgcagctgcaggagagcggccctggactggtgaagcccagcgagaccctgagcctgatgtgcaccgtgagcggcggcagcatcaccagcagcagctactactggggatggatcagacagccccctggcaagggcctggagtggatcggcaacatctactacagcggcaccacctactacaaccccagcctgaagagcagggtgaccatcagcgtggacaccagcaagaaccagttcagcctgaagctgagcagcgtgacagctgccgacaccgccgtgtactactgtgccgccggagccagagacttcgacagctggggacagggcagcctggtgaccgtgtccagcggcggatctgagggaaagtccagcggctccggcagcgaaagcaagtccaccggcggaagcgacatcgtgatgacccagagccctgatagcctggccgtgagcctgggagagagagccaccatcaactgcaagtcctcccagagcgtgctgtacagctccagcaacaagagctacctggcctggtaccagcagaggcccggacagcctcccaagctgctgatctactgggccagcaccagagagagcggcgtgcctgacaggtttagcggctccggctccggcaccgactttaccctgaccatcagcagcctgcaggccgaggatgtggccgtgtactactgccagcagtactacagcacccccaggatgtacaccttcggccagggcaccaagctggagatcaag

SEQ ID NO: 632 - DNA, 756 bp, Artificial Sequence
  Description of Artificial Sequence: Synthetic polynucleotide
gacatcgtgatgacccagagccctgatagcctggccgtgagcctgggagagagagccaccatcaactgcaagtcctcccagagcgtgctgtacagctccagcaacaagagctacctggcctggtaccagcagaggcccggacagcctcccaagctgctgatctactgggccagcaccagagagagcggcgtgcctgacaggtttagcggctccggctccggcaccgactttaccctgaccatcagcagcctgcaggccgaggatgtggccgtgtactactgccagcagtactacagcacccccaggatgtacaccttcggccagggcaccaagctggagatcaagggcggatctgagggaaagtccagcggctccggcagcgaaagcaagtccaccggcggaagccagctgcagctgcaggagagcggccctggactggtgaagcccagcgagaccctgagcctgatgtgcaccgtgagcggcggcagcatcaccagcagcagctactactggggatggatcagacagccccctggcaagggcctggagtggatcggcaacatctactacagcggcaccacctactacaaccccagcctgaagagcagggtgaccatcagcgtggacaccagcaagaaccagttcagcctgaagctgagcagcgtgacagctgccgacaccgccgtgtactactgtgccgccggagccagagacttcgacagctggggacagggcagcctggtgaccgtgtccagc

SEQ ID NO: 633 - DNA, 762 bp, Artificial Sequence
  Description of Artificial Sequence: Synthetic polynucleotide
gaggtgcagctgttggagtcaggtccaggactggtgaagccctcgcagaccctctcactcacctgtgtcatctccggggacagtgtctctagcaacagagctgcttggaactggatcaggcagtccccatcgagaggccttgagtggctgggaaggacatactacaggtccaagtggtataatgattatgcagtatctgtgaaaagtcgaataaccatcaattcagacacatccaagaaccagatctccctgcagttgaactctgtgactcccgaggacacggctgtgtattactgtgcaagagtgagaccggggatcccatttgactactggggccagggaaccccggtcaccgtctcctcaggcggatctgagggaaagtccagcggctccggcagcgaaagcaagtccaccggcggaagcgacatcgtgatgacccagtctccagactccctggctgtgtctctgggcgagagggccaccatcaactgcaagtccagccagagtgttttattcagctccaacaaaaagaactacttagcttggtaccagcagaaaccaggacagccccctaagctgctcatttactgggcatctacccgggaatccggggtccctgaccgattcagtggcagcgggtctgggacagatttcactctcaccatcagcagcctgcaggctgaagatgtggcagtttattactgtcagcaatataatagtactccgtggacgttcggccaagggaccaaggtggagatcaaa

SEQ ID NO: 634 - DNA, 762 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttattcagctccaacaaaaagaactacttagcttggtaccagcagaaaccaggacagccccctaagctgctcatttactgggcatctacccgggaatccggggtccctgaccgattcagtggcagcgggtctgggacagatttcactctcaccatcagcagcctgcaggctgaagatgtggcagtttattactgtcagcaatataatagtactccgtggacgttcggccaagggaccaaggtggagatcaaaggcggatctgagggaaagtccagcggctccggcagcgaaagcaagtccaccggcggaagcgaggtgcagctgttggagtcaggtccaggactggtgaagccctcgcagaccctctcactcacctgtgtcatctccggggacagtgtctctagcaacagagctgcttggaactggatcaggcagtccccatcgagaggccttgagtggctgggaaggacatactacaggtccaagtggtataatgattatgcagtatctgtgaaaagtcgaataaccatcaattcagacacatccaagaaccagatctccctgcagttgaactctgtgactcccgaggacacggctgtgtattactgtgcaagagtgagaccggggatcccatttgactactggggccagggaaccccggtcaccgtctcctca

SEQ ID NO: 635 - DNA, 762 bp, Artificial Sequence
  Description of Artificial Sequence: Synthetic polynucleotide
caggtacagctgcagcagtcaggtccaggactggtgaagccctcgcagaccctctcactcacctgtgtcatctccggggacagtgtctctagcaacagagctgcctggaactggatcaggcagtccccatcgagaggccttgagtggctgggaaggacatactacaggtccaagtggtataatgattatgcagtttctgtgaaaagtcgaataaccatcaattcagacacatccaagaaccagatctccctgcagttgaactctgtgactcccgaggacacggctgtgtattactgtgcaagagtgagaccggggatcccttttgactactggggccagggaaccacggtcaccgtctcctcaggcggatctgagggaaagtccagcggctccggcagcgaaagcaagtccaccggcggaagcgacatccagatgacccagtctccagactccctggctgtgtctctgggcgagagggccaccatcaactgcgagtccagccagagtgttttattcagctccaacaaaaagaactacttagcttggtaccagcagaaaccaggacagccccctaagctgctcatttactgggcatctacccgggaatccggggtccctgaccgattcagtggcagcgggtctgggacagatttcactctcaccatcaaccgcctgcaggctgaagatgtggcagtttattactgtcagcaatataatagtactccgtggacgttcggccaagggaccaaggtggagatcaaa

SEQ ID NO: 636 - DNA, 762 bp, Artificial Sequence
  Description of Artificial Sequence: Synthetic polynucleotide
gacatccagatgacccagtctccagactccctggctgtgtctctgggcgagagggccaccatcaactgcgagtccagccagagtgttttattcagctccaacaaaaagaactacttagcttggtaccagcagaaaccaggacagccccctaagctgctcatttactgggcatctacccgggaatccggggtccctgaccgattcagtggcagcgggtctgggacagatttcactctcaccatcaaccgcctgcaggctgaagatgtggcagtttattactgtcagcaatataatagtactccgtggacgttcggccaagggaccaaggtggagatcaaaggcggatctgagggaaagtccagcggctccggcagcgaaagcaagtccaccggcggaagccaggtacagctgcagcagtcaggtccaggactggtgaagccctcgcagaccctctcactcacctgtgtcatctccggggacagtgtctctagcaacagagctgcctggaactggatcaggcagtccccatcgagaggccttgagtggctgggaaggacatactacaggtccaagtggtataatgattatgcagtttctgtgaaaagtcgaataaccatcaattcagacacatccaagaaccagatctccctgcagttgaactctgtgactcccgaggacacggctgtgtattactgtgcaagagtgagaccggggatcccttttgactactggggccagggaaccacggtcaccgtctcctca

SEQ ID NO: 637 - DNA, 741 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgcactgggtccgccaggccccagggaaggggctggactgggtctcaggtattagtggtagtggctttagcacatactatgtagactccgtgaagggccggttcaccatctccagagacaattccaagcacacgctgtatctgcaaatgaacagcctgagagccgaggacacggccgtatattactgtgcgaaagataatttagtggctggtaccgtctttgactactggggccagggaaccctggtcaccgtctcctcaggcggatctgagggaaagtccagcggctccggcagcgaaagcaagtccaccggcggaagcgacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattcgctcactttcggcggagggaccaaggtggatatcaaa

SEQ ID NO: 638 - DNA, 741 bp, Artificial Sequence
  Description of Artificial Sequence: Synthetic polynucleotide
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattcgctcactttcggcggagggaccaaggtggatatcaaaggcggatctgagggaaagtccagcggctccggcagcgaaagcaagtccaccggcggaagcgaggtgcagctgttggagtctgggggaggcttggtacagcctggggggtccctgagactctcctgtgcagcctctggattcacctttagcagctatgccatgcactgggtccgccaggccccagggaaggggctggactgggtctcaggtattagtggtagtggctttagcacatactatgtagactccgtgaagggccggttcaccatctccagagacaattccaagcacacgctgtatctgcaaatgaacagcctgagagccgaggacacggccgtatattactgtgcgaaagataatttagtggctggtaccgtctttgactactggggccagggaaccctggtcaccgtctcctca

SEQ ID NO: 639 - DNA, 774 bp, Artificial Sequence
  Description of Artificial Sequence: Synthetic polynucleotide
caagtacaactgcaacaaagtggtcctgggctcgtgaagccttcccagactctcagcctcacatgcgctataagtggggattctgtttcctcaaattcagcagcctggaattggatacgacagtctccatcccgtggccttgagtggcttggtagaacttattaccgatccaagtggtacaatgattacgccgtttcagtgaagtcccgcattactattaatcccgacacatctaagaatcaaatttcattgcaactgaatagcgtaacacccgaagatacagcagtttattattgtgcaggtgatcgacgctacggcatagtgggacttcctttcgcctattggggccaagggacactggtcactgtgtcatccggcggatctgagggaaagtccagcggctccggcagcgaaagcaagtccaccggcggaagcgacatcgtaatgacacagtcaccagattcattggcagttagtctgggtgaaagggcaacaatcaactgcaagtcttctcagagtgtactgcatagttctaacaataagaactaccttacctggtttcaacagaaaccaggtcagccccccaagttgctgatttactgggcaagcacccgcgaatccggcgttcccgatcgattttcaggttccgggagtgggaccgactttaccttgaccatctcttccttgcaggccgaagatgtagccgtctattactgccatcagtattactctactccccccacattcggtcaaggtacaaaagttgagataaaa

SEQ ID NO: 640 - DNA, 774 bp, Artificial Sequence
  Description of Artificial Sequence: Synthetic polynucleotide
gacatcgtaatgacacagtcaccagattcattggcagttagtctgggtgaaagggcaacaatcaactgcaagtcttctcagagtgtactgcatagttctaacaataagaactaccttacctggtttcaacagaaaccaggtcagccccccaagttgctgatttactgggcaagcacccgcgaatccggcgttcccgatcgattttcaggttccgggagtgggaccgactttaccttgaccatctcttccttgcaggccgaagatgtagccgtctattactgccatcagtattactctactccccccacattcggtcaaggtacaaaagttgagataaaaggcggatctgagggaaagtccagcggctccggcagcgaaagcaagtccaccggcggaagccaagtacaactgcaacaaagtggtcctgggctcgtgaagccttcccagactctcagcctcacatgcgctataagtggggattctgtttcctcaaattcagcagcctggaattggatacgacagtctccatcccgtggccttgagtggcttggtagaacttattaccgatccaagtggtacaatgattacgccgtttcagtgaagtcccgcattactattaatcccgacacatctaagaatcaaatttcattgcaactgaatagcgtaacacccgaagatacagcagtttattattgtgcaggtgatcgacgctacggcatagtgggacttcctttcgcctattggggccaagggacactggtcactgtgtcatcc

SEQ ID NO: 641 - DNA, 741 bp, Artificial Sequence
  Description of Artificial Sequence: Synthetic polynucleotide
gaggtgcaactccttgaatcaggcggaggactcgtccaacctggagggagtcttaggcttagctgtgcagccagtggctttacttttagcagctatgcaatgcactgggtcaggcaggctcctggtaaggggctcgaatgggtcagcggcatatccgggtcaggtttctctacatattatgtcgattctgtaaaaggacgattcaccatatccagagacaattctaaaaataccttgtatctccagatgaacagcctgagagcagaagataccgcagtttattactgtgcaaaggataatctggttgccgggacagtttttgattattgggggcaaggcaccctcgtcacagtatccagtggcggatctgagggaaagtccagcggctccggcagcgaaagcaagtccaccggcggaagcgatattcagatgactcaatcaccttcaacccttagcgcctccgttggagatcgcgttaccattacctgccgagcctcccaaagtatcagctcatggttggcatggtatcaacagaagcctggaaaggcacccaaacttctgatttacaaagccagctccttggagtcaggagtcccaagccggttcagcggatctgggtcagggacagaatttaccctgaccatatcttcccttcagcccgacgacttcgccacttactattgtcagcaatacaactcctattccctgactttcggcggtggcacaaaggttgacatcaag

SEQ ID NO: 642 - DNA, 741 bp, Artificial Sequence
  Description of Artificial Sequence: Synthetic polynucleotide
gatattcagatgactcaatcaccttcaacccttagcgcctccgttggagatcgcgttaccattacctgccgagcctcccaaagtatcagctcatggttggcatggtatcaacagaagcctggaaaggcacccaaacttctgatttacaaagccagctccttggagtcaggagtcccaagccggttcagcggatctgggtcagggacagaatttaccctgaccatatcttcccttcagcccgacgacttcgccacttactattgtcagcaatacaactcctattccctgactttcggcggtggcacaaaggttgacatcaagggcggatctgagggaaagtccagcggctccggcagcgaaagcaagtccaccggcggaagcgaggtgcaactccttgaatcaggcggaggactcgtccaacctggagggagtcttaggcttagctgtgcagccagtggctttacttttagcagctatgcaatgcactgggtcaggcaggctcctggtaaggggctcgaatgggtcagcggcatatccgggtcaggtttctctacatattatgtcgattctgtaaaaggacgattcaccatatccagagacaattctaaaaataccttgtatctccagatgaacagcctgagagcagaagataccgcagtttattactgtgcaaaggataatctggttgccgggacagtttttgattattgggggcaaggcaccctcgtcacagtatccagt

SEQ ID NO: 643 - DNA, 762 bp, Artificial Sequence
  Description of Artificial Sequence: Synthetic polynucleotide
caggtgcagcttcaacagagcggacctggtctggttaagccttcccaaaccctgagcctgacttgtgctatttccggggatagtgttagctccaatagggcagcatggaactggatcagacagtccccaagccgtggacttgagtggcttggacgtacttattacaggagtaaatggtacaatgattatgccgtttctgtgaagagccgtattactataaacccagatacttctaaaaatcaaatttcccttcagctcaactcagttacaccagaggatactgcagtctattattgcgcaagagttcgacctggcattcccttcgattattgggggcaggggacacccgttactgtgtcctcaggcggatctgagggaaagtccagcggctccggcagcgaaagcaagtccaccggcggaagcgatattgttatgacacagtccccagattcattggcagtaagcctcggtgaacgggctactattaactgtaagtcttcccagagtgtattgttctcttcaaataacaaaaactacctggcatggtatcagcaaaagcctggtcaaccccctaaacttctcatatactgggcatccactcgggagagcggtgtgccagaccgtttctcagggagtgtgtcaggtacagattttacactcacaatttccagcctccaagccgaagacgttgcagtatattattgccaacaatatcactctacaccttggacatttggtcaaggtactaaagtcgaaatcaaa

SEQ ID NO: 644 - DNA, 762 bp, Artificial Sequence
  Description of Artificial Sequence: Synthetic polynucleotide
gatattgttatgacacagtccccagattcattggcagtaagcctcggtgaacgggctactattaactgtaagtcttcccagagtgtattgttctcttcaaataacaaaaactacctggcatggtatcagcaaaagcctggtcaaccccctaaacttctcatatactgggcatccactcgggagagcggtgtgccagaccgtttctcagggagtgtgtcaggtacagattttacactcacaatttccagcctccaagccgaagacgttgcagtatattattgccaacaatatcactctacaccttggacatttggtcaaggtactaaagtcgaaatcaaaggcggatctgagggaaagtccagcggctccggcagcgaaagcaagtccaccggcggaagccaggtgcagcttcaacagagcggacctggtctggttaagccttcccaaaccctgagcctgacttgtgctatttccggggatagtgttagctccaatagggcagcatggaactggatcagacagtccccaagccgtggacttgagtggcttggacgtacttattacaggagtaaatggtacaatgattatgccgtttctgtgaagagccgtattactataaacccagatacttctaaaaatcaaatttcccttcagctcaactcagttacaccagaggatactgcagtctattattgcgcaagagttcgacctggcattcccttcgattattgggggcaggggacacccgttactgtgtcctca

SEQ ID NO: 645 - DNA, 1470 bp, Artificial Sequence
  Description of Artificial Sequence: Synthetic polynucleotide
caggtgcagctgcagcagagcggccctggactggtgaagcccagccagaccctgagcctgacctgcgctatcagcggcgatagcgtgagctccaacagcgccgcctggaactggatcaggcagagccctagcaggggcctggaatggctgggcaggacctactacaggagcaagtggtacaacgactacgccgtgtccgtgaagagcaggatcaccatcaaccccgacaccagcaagaaccagatcagcctgcagctgaacagcgtgacccccgaggacaccgccgtgtactactgcgccggcgacagaaggtacggcatcgtgggcctgcctttcgcctactggggccagggaaccctggtgaccgtgagcagcggcggatctgagggaaagtccagcggctccggcagcgaaagcaagtccaccggcggaagcgacatcgtgatgacccagagccccgatagcctggctgtgagcctgggcgagagagccaccatcaactgcaagagcagccagagcgtgctgcacagcagcaacaacaagaactacctgacctggttccagcagaagcccggccagcctcccaagctgctgatctactgggctagcaccagagagtccggcgtgcctgacaggttcagcggaagcggcagcggcaccgacttcaccctgaccatcagcagcctgcaggccgaggacgtggccgtgtactactgccaccagtactacagcaccccccctacctttggccagggcaccaaggtggagatcaaggagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 646 - DNA, 1470 bp, Artificial Sequence
  Description of Artificial Sequence: Synthetic polynucleotide
gacatcgtgatgacccagagccccgatagcctggctgtgagcctgggcgagagagccaccatcaactgcaagagcagccagagcgtgctgcacagcagcaacaacaagaactacctgacctggttccagcagaagcccggccagcctcccaagctgctgatctactgggctagcaccagagagtccggcgtgcctgacaggttcagcggaagcggcagcggcaccgacttcaccctgaccatcagcagcctgcaggccgaggacgtggccgtgtactactgccaccagtactacagcaccccccctacctttggccagggcaccaaggtggagatcaagggcggatctgagggaaagtccagcggctccggcagcgaaagcaagtccaccggcggaagccaggtgcagctgcagcagagcggccctggactggtgaagcccagccagaccctgagcctgacctgcgctatcagcggcgatagcgtgagctccaacagcgccgcctggaactggatcaggcagagccctagcaggggcctggaatggctgggcaggacctactacaggagcaagtggtacaacgactacgccgtgtccgtgaagagcaggatcaccatcaaccccgacaccagcaagaaccagatcagcctgcagctgaacagcgtgacccccgaggacaccgccgtgtactactgcgccggcgacagaaggtacggcatcgtgggcctgcctttcgcctactggggccagggaaccctggtgaccgtgagcagcgagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 647 - DNA, 1464 bp, Artificial Sequence
  Description of Artificial Sequence: Synthetic polynucleotide
caggtgcagctgcagcagagcggacccggcctggtgaaacccagccagaccctgagcctgacctgcgccatcagcggcgacagcgtgagcaacaacagcgccgcctggaactggatcaggcagagccccagcagaggcctggaatggctgggcaggacctactacaggagcaagtggtacaacgactacgccgtgagcgtgaagagcaggatcaccatcaaccccgacacctccaagaaccagttcagcctgcagctgaacagcgtgacccccgaggacaccgccgtgtactactgcgccaggtatggcagcggcaccctgctgttcgactactggggccagggcaccctggtgacagtgagcagcggcggatctgagggaaagtccagcggctccggcagcgaaagcaagtccaccggcggaagcgacatcgtgatgacccagagccccgatagcctggctgtgagcctgggagagagggccaccatcaactgcaagagcagccagagcgtgctgtacagcagcaagaacaagaactacctggcctggtaccagcagaaacccggccagccccccaagctgctgatctactgggccagcacaagggaaagcggcgtgcccgacagattcagcggaagcggcagcggcaccgacttcaccctgaccatcagcagcctgcaggccgaggatgtggccgtgtactactgccagcagtactacagcaccttcccctacaccttcggccagggcaccaagctggagatcaaggagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 648 - DNA, 1464 bp, Artificial Sequence
  Description of Artificial Sequence: Synthetic polynucleotide
gacatcgtgatgacccagagccccgatagcctggctgtgagcctgggagagagggccaccatcaactgcaagagcagccagagcgtgctgtacagcagcaagaacaagaactacctggcctggtaccagcagaaacccggccagccccccaagctgctgatctactgggccagcacaagggaaagcggcgtgcccgacagattcagcggaagcggcagcggcaccgacttcaccctgaccatcagcagcctgcaggccgaggatgtggccgtgtactactgccagcagtactacagcaccttcccctacaccttcggccagggcaccaagctggagatcaagggcggatctgagggaaagtccagcggctccggcagcgaaagcaagtccaccggcggaagccaggtgcagctgcagcagagcggacccggcctggtgaaacccagccagaccctgagcctgacctgcgccatcagcggcgacagcgtgagcaacaacagcgccgcctggaactggatcaggcagagccccagcagaggcctggaatggctgggcaggacctactacaggagcaagtggtacaacgactacgccgtgagcgtgaagagcaggatcaccatcaaccccgacacctccaagaaccagttcagcctgcagctgaacagcgtgacccccgaggacaccgccgtgtactactgcgccaggtatggcagcggcaccctgctgttcgactactggggccagggcaccctggtgacagtgagcagcgagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 649 - DNA, 1470 bp, Artificial Sequence
  Description of Artificial Sequence: Synthetic polynucleotide
caggtgcagctgcagcagagcggacccggactggtgagacccagccagaccctgagcgtgacctgcgccatcagcggcgacagcgtgagcagcaacagcgccagctggaactggatcaggcagagccccagcagaggcctggagtggctgggaaggacatactacaggagcgagtggttcaacgactacgccgtgagcgtgaagagcagggtgaccatcaaccccgacaccagcaagaaccagctgagcctgcagctgaacagcgtgatccccgaggacaccgccgtgtactactgcgccagagaggccagaatcggcgtggccggcaaaggcttcgactactggggccagggcaccctggtgacagtgtccagcggcggatctgagggaaagtccagcggctccggcagcgaaagcaagtccaccggcggaagcgacatcgtgatgacccagagccctgactccctggctgtgagcctgggcgagagagccaccatcaactgcaagagcagccagagcgtgctgttcaggagcaacaacaagaactacctggcctggttccagcagaagcccggccagcctcccaagctgctgatctactgggccagcaccagagagagcggcgtgcccgatagatttagcggcagcggcagcggcaccgactttaccctgaccatcagctccctgcaggccgaggatgtggccgtgtactactgccagcagtactacagcacccccagaaccttcggccagggcaccaaggtggagatcaaggagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 650 - DNA, 1470 bp, Artificial Sequence
  Description of Artificial Sequence: Synthetic polynucleotide
gacatcgtgatgacccagagccctgactccctggctgtgagcctgggcgagagagccaccatcaactgcaagagcagccagagcgtgctgttcaggagcaacaacaagaactacctggcctggttccagcagaagcccggccagcctcccaagctgctgatctactgggccagcaccagagagagcggcgtgcccgatagatttagcggcagcggcagcggcaccgactttaccctgaccatcagctccctgcaggccgaggatgtggccgtgtactactgccagcagtactacagcacccccagaaccttcggccagggcaccaaggtggagatcaagggcggatctgagggaaagtccagcggctccggcagcgaaagcaagtccaccggcggaagccaggtgcagctgcagcagagcggacccggactggtgagacccagccagaccctgagcgtgacctgcgccatcagcggcgacagcgtgagcagcaacagcgccagctggaactggatcaggcagagccccagcagaggcctggagtggctgggaaggacatactacaggagcgagtggttcaacgactacgccgtgagcgtgaagagcagggtgaccatcaaccccgacaccagcaagaaccagctgagcctgcagctgaacagcgtgatccccgaggacaccgccgtgtactactgcgccagagaggccagaatcggcgtggccggcaaaggcttcgactactggggccagggcaccctggtgacagtgtccagcgagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 651 - DNA, 1458 bp, Artificial Sequence
  Description of Artificial Sequence: Synthetic polynucleotide
caggtgcagctgcagcagagcggacctggcctggtgaagcccagccagaccctgagcctgacatgcgccatcagcggcgacagcgtgagcagcaatagggccgcctggaactggatcaggcagacccctagcaggggcctggaatggctgggcaggacatactacaggagcgagtggtacaacgactacgccgtgtccgtgaagagcaggatcaccatcaaccccgacaccagcaagaaccagttcagcctgcagctgaacagcgtgacccccgaggacaccgccgtgtactactgcgccagagtgagagccgccgtgcctttcgactactggggccagggcaccctggtgacagtgagcagcggcggatctgagggaaagtccagcggctccggcagcgaaagcaagtccaccggcggaagcgacatcgtgatgacccagagccccgatagcctggctgtgagcctgggcgagagggccaccatcaactgcaagagcagccagagcgtgctgttttccagcaacaacaagaactacctggcctggtaccagcagaaacccggccagccccccaacctgctgatctactgggccagcaccagagaaagcggcgtgcccgacaggtttagcggcagcgtgagcggcaccgacttcaccctgaccatcagcagcctgcaggccgaggacgtggccatctactactgccagcagtaccacagcaccccctggacattcggccagggcaccaaggtggagatcaaggagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 652 - DNA, 1458 bp, Artificial Sequence
  Description of Artificial Sequence: Synthetic polynucleotide
gacatcgtgatgacccagagccccgatagcctggctgtgagcctgggcgagagggccaccatcaactgcaagagcagccagagcgtgctgttttccagcaacaacaagaactacctggcctggtaccagcagaaacccggccagccccccaacctgctgatctactgggccagcaccagagaaagcggcgtgcccgacaggtttagcggcagcgtgagcggcaccgacttcaccctgaccatcagcagcctgcaggccgaggacgtggccatctactactgccagcagtaccacagcaccccctggacattcggccagggcaccaaggtggagatcaagggcggatctgagggaaagtccagcggctccggcagcgaaagcaagtccaccggcggaagccaggtgcagctgcagcagagcggacctggcctggtgaagcccagccagaccctgagcctgacatgcgccatcagcggcgacagcgtgagcagcaatagggccgcctggaactggatcaggcagacccctagcaggggcctggaatggctgggcaggacatactacaggagcgagtggtacaacgactacgccgtgtccgtgaagagcaggatcaccatcaaccccgacaccagcaagaaccagttcagcctgcagctgaacagcgtgacccccgaggacaccgccgtgtactactgcgccagagtgagagccgccgtgcctttcgactactggggccagggcaccctggtgacagtgagcagcgagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 653 - DNA, 1452 bp, Artificial Sequence
  Description of Artificial Sequence: Synthetic polynucleotide
cagctgcagctgcaggagagcggccctggactggtgaagcccagcgagaccctgagcctgatgtgcaccgtgagcggcggcagcatcaccagcagcagctactactggggatggatcagacagccccctggcaagggcctggagtggatcggcaacatctactacagcggcaccacctactacaaccccagcctgaagagcagggtgaccatcagcgtggacaccagcaagaaccagttcagcctgaagctgagcagcgtgacagctgccgacaccgccgtgtactactgtgccgccggagccagagacttcgacagctggggacagggcagcctggtgaccgtgtccagcggcggatctgagggaaagtccagcggctccggcagcgaaagcaagtccaccggcggaagcgacatcgtgatgacccagagccctgatagcctggccgtgagcctgggagagagagccaccatcaactgcaagtcctcccagagcgtgctgtacagctccagcaacaagagctacctggcctggtaccagcagaggcccggacagcctcccaagctgctgatctactgggccagcaccagagagagcggcgtgcctgacaggtttagcggctccggctccggcaccgactttaccctgaccatcagcagcctgcaggccgaggatgtggccgtgtactactgccagcagtactacagcacccccaggatgtacaccttcggccagggcaccaagctggagatcaaggagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 654 - DNA, 1452 bp, Artificial Sequence
  Description of Artificial Sequence: Synthetic polynucleotide
gacatcgtgatgacccagagccctgatagcctggccgtgagcctgggagagagagccaccatcaactgcaagtcctcccagagcgtgctgtacagctccagcaacaagagctacctggcctggtaccagcagaggcccggacagcctcccaagctgctgatctactgggccagcaccagagagagcggcgtgcctgacaggtttagcggctccggctccggcaccgactttaccctgaccatcagcagcctgcaggccgaggatgtggccgtgtactactgccagcagtactacagcacccccaggatgtacaccttcggccagggcaccaagctggagatcaagggcggatctgagggaaagtccagcggctccggcagcgaaagcaagtccaccggcggaagccagctgcagctgcaggagagcggccctggactggtgaagcccagcgagaccctgagcctgatgtgcaccgtgagcggcggcagcatcaccagcagcagctactactggggatggatcagacagccccctggcaagggcctggagtggatcggcaacatctactacagcggcaccacctactacaaccccagcctgaagagcagggtgaccatcagcgtggacaccagcaagaaccagttcagcctgaagctgagcagcgtgacagctgccgacaccgccgtgtactactgtgccgccggagccagagacttcgacagctggggacagggcagcctggtgaccgtgtccagcgagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 655 - DNA, 1458 bp, Artificial Sequence
  Description of Artificial Sequence: Synthetic polynucleotide
gaggtgcagctgttggagtcaggtccaggactggtgaagccctcgcagaccctctcactcacctgtgtcatctccggggacagtgtctctagcaacagagctgcttggaactggatcaggcagtccccatcgagaggccttgagtggctgggaaggacatactacaggtccaagtggtataatgattatgcagtatctgtgaaaagtcgaataaccatcaattcagacacatccaagaaccagatctccctgcagttgaactctgtgactcccgaggacacggctgtgtattactgtgcaagagtgagaccggggatcccatttgactactggggccagggaaccccggtcaccgtctcctcaggcggatctgagggaaagtccagcggctccggcagcgaaagcaagtccaccggcggaagcgacatcgtgatgacccagtctccagactccctggctgtgtctctgggcgagagggccaccatcaactgcaagtccagccagagtgttttattcagctccaacaaaaagaactacttagcttggtaccagcagaaaccaggacagccccctaagctgctcatttactgggcatctacccgggaatccggggtccctgaccgattcagtggcagcgggtctgggacagatttcactctcaccatcagcagcctgcaggctgaagatgtggcagtttattactgtcagcaatataatagtactccgtggacgttcggccaagggaccaaggtggagatcaaagagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 656 - DNA, 1458 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttattcagctccaacaaaaagaactacttagcttggtaccagcagaaaccaggacagccccctaagctgctcatttactgggcatctacccgggaatccggggtccctgaccgattcagtggcagcgggtctgggacagatttcactctcaccatcagcagcctgcaggctgaagatgtggcagtttattactgtcagcaatataatagtactccgtggacgttcggccaagggaccaaggtggagatcaaaggcggatctgagggaaagtccagcggctccggcagcgaaagcaagtccaccggcggaagcgaggtgcagctgttggagtcaggtccaggactggtgaagccctcgcagaccctctcactcacctgtgtcatctccggggacagtgtctctagcaacagagctgcttggaactggatcaggcagtccccatcgagaggccttgagtggctgggaaggacatactacaggtccaagtggtataatgattatgcagtatctgtgaaaagtcgaataaccatcaattcagacacatccaagaaccagatctccctgcagttgaactctgtgactcccgaggacacggctgtgtattactgtgcaagagtgagaccggggatcccatttgactactggggccagggaaccccggtcaccgtctcctcagagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 657 - DNA, 1458 bp, Artificial Sequence
  Description of Artificial Sequence: Synthetic polynucleotide
caggtacagctgcagcagtcaggtccaggactggtgaagccctcgcagaccctctcactcacctgtgtcatctccggggacagtgtctctagcaacagagctgcctggaactggatcaggcagtccccatcgagaggccttgagtggctgggaaggacatactacaggtccaagtggtataatgattatgcagtttctgtgaaaagtcgaataaccatcaattcagacacatccaagaaccagatctccctgcagttgaactctgtgactcccgaggacacggctgtgtattactgtgcaagagtgagaccggggatcccttttgactactggggccagggaaccacggtcaccgtctcctcaggcggatctgagggaaagtccagcggctccggcagcgaaagcaagtccaccggcggaagcgacatccagatgacccagtctccagactccctggctgtgtctctgggcgagagggccaccatcaactgcgagtccagccagagtgttttattcagctccaacaaaaagaactacttagcttggtaccagcagaaaccaggacagccccctaagctgctcatttactgggcatctacccgggaatccggggtccctgaccgattcagtggcagcgggtctgggacagatttcactctcaccatcaaccgcctgcaggctgaagatgtggcagtttattactgtcagcaatataatagtactccgtggacgttcggccaagggaccaaggtggagatcaaagagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 658 - DNA, 1458 bp, Artificial Sequence
  Description of Artificial Sequence: Synthetic polynucleotide
gacatccagatgacccagtctccagactccctggctgtgtctctgggcgagagggccaccatcaactgcgagtccagccagagtgttttattcagctccaacaaaaagaactacttagcttggtaccagcagaaaccaggacagccccctaagctgctcatttactgggcatctacccgggaatccggggtccctgaccgattcagtggcagcgggtctgggacagatttcactctcaccatcaaccgcctgcaggctgaagatgtggcagtttattactgtcagcaatataatagtactccgtggacgttcggccaagggaccaaggtggagatcaaaggcggatctgagggaaagtccagcggctccggcagcgaaagcaagtccaccggcggaagccaggtacagctgcagcagtcaggtccaggactggtgaagccctcgcagaccctctcactcacctgtgtcatctccggggacagtgtctctagcaacagagctgcctggaactggatcaggcagtccccatcgagaggccttgagtggctgggaaggacatactacaggtccaagtggtataatgattatgcagtttctgtgaaaagtcgaataaccatcaattcagacacatccaagaaccagatctccctgcagttgaactctgtgactcccgaggacacggctgtgtattactgtgcaagagtgagaccggggatcccttttgactactggggccagggaaccacggtcaccgtctcctcagagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 659 - DNA, 1437 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgcactgggtccgccaggccccagggaaggggctggactgggtctcaggtattagtggtagtggctttagcacatactatgtagactccgtgaagggccggttcaccatctccagagacaattccaagcacacgctgtatctgcaaatgaacagcctgagagccgaggacacggccgtatattactgtgcgaaagataatttagtggctggtaccgtctttgactactggggccagggaaccctggtcaccgtctcctcaggcggatctgagggaaagtccagcggctccggcagcgaaagcaagtccaccggcggaagcgacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattcgctcactttcggcggagggaccaaggtggatatcaaagagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 660 - DNA, 1437 bp, Artificial Sequence
  Description of Artificial Sequence: Synthetic polynucleotide
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattcgctcactttcggcggagggaccaaggtggatatcaaaggcggatctgagggaaagtccagcggctccggcagcgaaagcaagtccaccggcggaagcgaggtgcagctgttggagtctgggggaggcttggtacagcctggggggtccctgagactctcctgtgcagcctctggattcacctttagcagctatgccatgcactgggtccgccaggccccagggaaggggctggactgggtctcaggtattagtggtagtggctttagcacatactatgtagactccgtgaagggccggttcaccatctccagagacaattccaagcacacgctgtatctgcaaatgaacagcctgagagccgaggacacggccgtatattactgtgcgaaagataatttagtggctggtaccgtctttgactactggggccagggaaccctggtcaccgtctcctcagagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 661 - DNA, 1470 bp, Artificial Sequence
  Description of Artificial Sequence: Synthetic polynucleotide
caagtacaactgcaacaaagtggtcctgggctcgtgaagccttcccagactctcagcctcacatgcgctataagtggggattctgtttcctcaaattcagcagcctggaattggatacgacagtctccatcccgtggccttgagtggcttggtagaacttattaccgatccaagtggtacaatgattacgccgtttcagtgaagtcccgcattactattaatcccgacacatctaagaatcaaatttcattgcaactgaatagcgtaacacccgaagatacagcagtttattattgtgcaggtgatcgacgctacggcatagtgggacttcctttcgcctattggggccaagggacactggtcactgtgtcatccggcggatctgagggaaagtccagcggctccggcagcgaaagcaagtccaccggcggaagcgacatcgtaatgacacagtcaccagattcattggcagttagtctgggtgaaagggcaacaatcaactgcaagtcttctcagagtgtactgcatagttctaacaataagaactaccttacctggtttcaacagaaaccaggtcagccccccaagttgctgatttactgggcaagcacccgcgaatccggcgttcccgatcgattttcaggttccgggagtgggaccgactttaccttgaccatctcttccttgcaggccgaagatgtagccgtctattactgccatcagtattactctactccccccacattcggtcaaggtacaaaagttgagataaaagagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 662 - DNA, 1470 bp, Artificial Sequence
  Description of Artificial Sequence: Synthetic polynucleotide
gacatcgtaatgacacagtcaccagattcattggcagttagtctgggtgaaagggcaacaatcaactgcaagtcttctcagagtgtactgcatagttctaacaataagaactaccttacctggtttcaacagaaaccaggtcagccccccaagttgctgatttactgggcaagcacccgcgaatccggcgttcccgatcgattttcaggttccgggagtgggaccgactttaccttgaccatctcttccttgcaggccgaagatgtagccgtctattactgccatcagtattactctactccccccacattcggtcaaggtacaaaagttgagataaaaggcggatctgagggaaagtccagcggctccggcagcgaaagcaagtccaccggcggaagccaagtacaactgcaacaaagtggtcctgggctcgtgaagccttcccagactctcagcctcacatgcgctataagtggggattctgtttcctcaaattcagcagcctggaattggatacgacagtctccatcccgtggccttgagtggcttggtagaacttattaccgatccaagtggtacaatgattacgccgtttcagtgaagtcccgcattactattaatcccgacacatctaagaatcaaatttcattgcaactgaatagcgtaacacccgaagatacagcagtttattattgtgcaggtgatcgacgctacggcatagtgggacttcctttcgcctattggggccaagggacactggtcactgtgtcatccgagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 663 - DNA, 1437 bp, Artificial Sequence
  Description of Artificial Sequence: Synthetic polynucleotide
gaggtgcaactccttgaatcaggcggaggactcgtccaacctggagggagtcttaggcttagctgtgcagccagtggctttacttttagcagctatgcaatgcactgggtcaggcaggctcctggtaaggggctcgaatgggtcagcggcatatccgggtcaggtttctctacatattatgtcgattctgtaaaaggacgattcaccatatccagagacaattctaaaaataccttgtatctccagatgaacagcctgagagcagaagataccgcagtttattactgtgcaaaggataatctggttgccgggacagtttttgattattgggggcaaggcaccctcgtcacagtatccagtggcggatctgagggaaagtccagcggctccggcagcgaaagcaagtccaccggcggaagcgatattcagatgactcaatcaccttcaacccttagcgcctccgttggagatcgcgttaccattacctgccgagcctcccaaagtatcagctcatggttggcatggtatcaacagaagcctggaaaggcacccaaacttctgatttacaaagccagctccttggagtcaggagtcccaagccggttcagcggatctgggtcagggacagaatttaccctgaccatatcttcccttcagcccgacgacttcgccacttactattgtcagcaatacaactcctattccctgactttcggcggtggcacaaaggttgacatcaaggagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 664 - DNA, 1437 bp, Artificial Sequence
  Description of Artificial Sequence: Synthetic polynucleotide
gatattcagatgactcaatcaccttcaacccttagcgcctccgttggagatcgcgttaccattacctgccgagcctcccaaagtatcagctcatggttggcatggtatcaacagaagcctggaaaggcacccaaacttctgatttacaaagccagctccttggagtcaggagtcccaagccggttcagcggatctgggtcagggacagaatttaccctgaccatatcttcccttcagcccgacgacttcgccacttactattgtcagcaatacaactcctattccctgactttcggcggtggcacaaaggttgacatcaagggcggatctgagggaaagtccagcggctccggcagcgaaagcaagtccaccggcggaagcgaggtgcaactccttgaatcaggcggaggactcgtccaacctggagggagtcttaggcttagctgtgcagccagtggctttacttttagcagctatgcaatgcactgggtcaggcaggctcctggtaaggggctcgaatgggtcagcggcatatccgggtcaggtttctctacatattatgtcgattctgtaaaaggacgattcaccatatccagagacaattctaaaaataccttgtatctccagatgaacagcctgagagcagaagataccgcagtttattactgtgcaaaggataatctggttgccgggacagtttttgattattgggggcaaggcaccctcgtcacagtatccagtgagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 665 - DNA, 1458 bp, Artificial Sequence
  Description of Artificial Sequence: Synthetic polynucleotide
caggtgcagcttcaacagagcggacctggtctggttaagccttcccaaaccctgagcctgacttgtgctatttccggggatagtgttagctccaatagggcagcatggaactggatcagacagtccccaagccgtggacttgagtggcttggacgtacttattacaggagtaaatggtacaatgattatgccgtttctgtgaagagccgtattactataaacccagatacttctaaaaatcaaatttcccttcagctcaactcagttacaccagaggatactgcagtctattattgcgcaagagttcgacctggcattcccttcgattattgggggcaggggacacccgttactgtgtcctcaggcggatctgagggaaagtccagcggctccggcagcgaaagcaagtccaccggcggaagcgatattgttatgacacagtccccagattcattggcagtaagcctcggtgaacgggctactattaactgtaagtcttcccagagtgtattgttctcttcaaataacaaaaactacctggcatggtatcagcaaaagcctggtcaaccccctaaacttctcatatactgggcatccactcgggagagcggtgtgccagaccgtttctcagggagtgtgtcaggtacagattttacactcacaatttccagcctccaagccgaagacgttgcagtatattattgccaacaatatcactctacaccttggacatttggtcaaggtactaaagtcgaaatcaaagagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 666 - DNA, 1458 bp, Artificial Sequence
  Description of Artificial Sequence: Synthetic polynucleotide
gatattgttatgacacagtccccagattcattggcagtaagcctcggtgaacgggctactattaactgtaagtcttcccagagtgtattgttctcttcaaataacaaaaactacctggcatggtatcagcaaaagcctggtcaaccccctaaacttctcatatactgggcatccactcgggagagcggtgtgccagaccgtttctcagggagtgtgtcaggtacagattttacactcacaatttccagcctccaagccgaagacgttgcagtatattattgccaacaatatcactctacaccttggacatttggtcaaggtactaaagtcgaaatcaaaggcggatctgagggaaagtccagcggctccggcagcgaaagcaagtccaccggcggaagccaggtgcagcttcaacagagcggacctggtctggttaagccttcccaaaccctgagcctgacttgtgctatttccggggatagtgttagctccaatagggcagcatggaactggatcagacagtccccaagccgtggacttgagtggcttggacgtacttattacaggagtaaatggtacaatgattatgccgtttctgtgaagagccgtattactataaacccagatacttctaaaaatcaaatttcccttcagctcaactcagttacaccagaggatactgcagtctattattgcgcaagagttcgacctggcattcccttcgattattgggggcaggggacacccgttactgtgtcctcagagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 667 - protein, 8 aa, Artificial Sequence
  Description of Artificial Sequence: Synthetic peptide
HHPVFDYE

SEQ ID NO: 668 - protein, 454 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITINPDTSKNQISLQLNSVTPEDTAVYYCAGDRRYGIVGLPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 669 - protein, 450 aa, Artificial Sequence
  Description of Artificial Sequence: Synthetic polypeptide
QVQLQQSGPGLVKPSQTLSLTCAISGDSVSSNRAAWNWIRQSPSRGLEWLGRTYYRSKWYNDYAVSVKSRITINPDTSKNQISLQLNSVTPEDTAVYYCARVRPGIPFDYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 670 - protein, 450 aa, Artificial Sequence; identical to SEQ ID NO: 669
  Description of Artificial Sequence: Synthetic polypeptide

SEQ ID NO: 671 - protein, 220 aa, Artificial Sequence; identical to SEQ ID NO: 546
  Description of Artificial Sequence: Synthetic polypeptide

SEQ ID NO: 672 - protein, 220 aa, Artificial Sequence; identical to SEQ ID NO: 556
  Description of Artificial Sequence: Synthetic polypeptide

SEQ ID NO: 673 - protein, 220 aa, Artificial Sequence; identical to SEQ ID NO: 556
  Description of Artificial Sequence: Synthetic polypeptide

SEQ ID NO: 674 - DNA, 1362 bp, Artificial Sequence
  Description of Artificial Sequence: Synthetic polynucleotide
caagtacaactgcaacaaagtggtcctgggctcgtgaagccttcccagactctcagcctcacatgcgctataagtggggattctgtttcctcaaattcagcagcctggaattggatacgacagtctccatcccgtggccttgagtggcttggtagaacttattaccgatccaagtggtacaatgattacgccgtttcagtgaagtcccgcattactattaatcccgacacatctaagaatcaaatttcattgcaactgaatagcgtaacacccgaagatacagcagtttattattgtgcaggtgatcgacgctacggcatagtgggacttcctttcgcctattggggccaagggacactggtcactgtgtcatccgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 675 - DNA, 660 bp, Artificial Sequence; identical to SEQ ID NO: 574
  Description of Artificial Sequence: Synthetic polynucleotide

SEQ ID NO: 676 - DNA, 1350 bp, Artificial Sequence
  Description of Artificial Sequence: Synthetic polynucleotide
caggtgcagcttcaacagagcggacctggtctggttaagccttcccaaaccctgagcctgacttgtgctatttccggggatagtgttagctccaatagggcagcatggaactggatcagacagtccccaagccgtggacttgagtggcttggacgtacttattacaggagtaaatggtacaatgattatgccgtttctgtgaagagccgtattactataaacccagatacttctaaaaatcaaatttcccttcagctcaactcagttacaccagaggatactgcagtctattattgcgcaagagttcgacctggcattcccttcgattattgggggcaggggacacccgttactgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 677 - DNA, 660 bp, Artificial Sequence; identical to SEQ ID NO: 578
  Description of Artificial Sequence: Synthetic polynucleotide

SEQ ID NO: 678 - DNA, 1350 bp, Artificial Sequence; identical to SEQ ID NO: 676
  Description of Artificial Sequence: Synthetic polynucleotide

SEQ ID NO: 679 - DNA, 660 bp, Artificial Sequence; identical to SEQ ID NO: 578
  Description of Artificial Sequence: Synthetic polynucleotide

SEQ ID NO: 680 - protein, 489 aa, Artificial Sequence
  Description of Artificial Sequence: Synthetic polypeptide
DIVMTQSPDSLAVSLGERATINCKSSQSVLHSSNNKNYLTWFQQKPGQPPKLLIYWASTRESGVPDRFSGSGSGTDFTLTISSLQAEDVAVYYCHQYYSTPPTFGQGTKVEIKGGSEGKSSGSGSESKSTGGSQVQLQQSGPGLVKPSQTLSLTCAISGDSVSSNSAAWNWIRQSPSRGLEWLGRTYYRSKWYNDYAVSVKSRITINPDTSKNQISLQLNSVTPEDTAVYYCAGDRRYGIVGLPFAYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 681 - protein, 478 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSGTEFTLTISSLQPDDFATYYCQQYNSYSLTFGGGTKVDIKGGSEGKSSGSGSESKSTGGSEVQLLESGGGLVQPGGSLRLSCAASGFTFSSYAMHWVRQAPGKGLEWVSGISGSGFSTYYVDSVKGRFTISRDNSKNTLYLQMNSLRAEDTAVYYCAKDNLVAGTVFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 682 - DNA, 1467 bp, Artificial Sequence
  Description of Artificial Sequence: Synthetic polynucleotide
gacatcgtgatgacccagtctccagacagcctggctgtgtctctgggcgagagagctaccatcaactgcaagtccagccagtccgtgctgcactcctccaacaacaagaactacctgacctggttccagcagaagcccggccagcctcctaagctgctgatctactgggcctccacccgcgagtctggtgtgcccgatagattctccggctctggctctggcaccgactttaccctgacaatcagctccctgcaggccgaggatgtggccgtgtactactgccaccagtactacagcacccctcctacctttggccagggcaccaaggtggaaatcaagggcggatctgagggaaagtccagcggctccggcagcgaaagcaagtccaccggcggaagccaggttcagctgcagcagtctggccctggactggtcaagccctctcagaccctgtctctgacctgtgccatctccggcgactccgtgtcctctaattctgccgcctggaactggatccggcagtctcctagtagaggcctggaatggctgggcagaacctactaccggtccaagtggtacaacgactacgccgtgtccgtgaagtcccggatcaccatcaatcccgacacctccaagaaccagatctccctgcagctcaacagcgtgacccctgaggataccgccgtgtactactgtgccggcgatcggagatatggcatcgtgggcctgccttttgcttactggggacagggcacactggtcaccgtttcttctgagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccggga

SEQ ID NO: 683 - DNA, 1434 bp, Artificial Sequence
  Description of Artificial Sequence: Synthetic polynucleotide
gatattcagatgacccaatcccccagtacccttagtgctagtgtgggagaccgagtgaccattacctgcagagcatcccaatccataagctcctggctcgcctggtatcagcaaaagccaggcaaggcacctaagctgcttatttacaaagcatcctcattggagtccggcgtaccctcacgtttctctggctcaggctccgggacagagtttacattgaccatctctagccttcagccagatgactttgctacatactattgtcaacaatataacagctactctctgaccttcgggggtgggaccaaagtggatattaaaggcggctccgagggcaagagcagcggcagcggcagcgagagcaagagcaccggcggcagcgaagtccaacttcttgagagtggtggtggcctcgtccagccaggaggttctctccggctctcatgtgctgcaagtggctttactttcagctcttacgccatgcactgggtgcgacaggctcccgggaagggtcttgagtgggtgtctggtataagtggttcaggcttttcaacctactatgtcgattccgtcaagggccggtttacaatttcaagggacaattctaagaatacactgtatctccaaatgaatagtctcagagccgaagataccgccgtttactactgcgccaaagataatcttgtggctgggactgtcttcgactattggggtcagggtacattggtaaccgtaagtagtgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 684 - protein, 481 aa, Artificial Sequence
  Description of Artificial Sequence: Synthetic polypeptide
QSALTQPASVSGSPGQSITISCTGTSSNIGTYKFVSWYQQHPGKAPKVMIYEVSKRPSGVSNRFSGSKSGNTASLTISGLQAEDEADYYCVSYAGSGTLLFGGGTKLTVLGGSEGKSSGSGSESKSTGGSQVQLQQSGPGLVKPSQTLSLTCAISGDSVFNNNAAWSWIRQSPSRGLEWLGRTYYRSKWLYDYAVSVKSRITINPDTSKNQFSLQLNSVTPEDTAVYYCARGYSSSFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 685 - protein, 485 aa, Artificial Sequence
  Description of Artificial Sequence: Synthetic polypeptide
QTVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGGSEGKSSGSGSESKSTGGSEVQLVESGGGLVQPGGSLRLSCAASGFTFNTYAMNWVRQAPGKGLEWVARIRSKYNNYATYYAASVKGRFTISRDDSKNSLYLQMNSLKTEDTAVYYCVRHGNFGNSYVSWFAYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 686 - protein, 475 aa, Artificial Sequence
  Description of Artificial Sequence: Synthetic polypeptide
DIQMTQSPSSLSASVGDRVTITCRASQSISSYLNWYQQKPGCAPKLLIYAASSLQSGVPSRFSGSGSGTDFTLTISSLQPEDFATYYCQQSYSTPLTFGQGTKVEIKGGGSGGSGGCPPCGGSGGEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKYDGIYGELDFWGCGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 687 - protein, 449 aa, Artificial Sequence
  Description of Artificial Sequence: Synthetic polypeptide
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 688 - protein, 218 aa, Artificial Sequence
  Description of Artificial Sequence: Synthetic polypeptide
DIVMTQSPDSLAVSLGERATINCRASQSVDYNGISYMHWYQQKPGQPPKLLIYAASNPESGVPDRFSGSGSGTDFTLTISSLQAEDVAVYYCQQIIEDPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 689 - protein, 454 aa, Artificial Sequence
  Description of Artificial Sequence: Synthetic polypeptide
EVQLVESGGGLVQPGGSLRLSCAASGFTFNTYAMNWVRQAPGKGLEWVARIRSKYNNYATYYAASVKGRFTISRDDSKNSLYLQMNSLKTEDTAVYYCVRHGNFGNSYVSWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 690 - protein, 215 aa, Artificial Sequence
  Description of Artificial Sequence: Synthetic polypeptide
QTVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 691 - protein, 338 aa, Homo sapiens
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 692 - protein, 449 aa, Artificial Sequence
  Description of Artificial Sequence: Synthetic polypeptide
QVQLVQSGAEVKKPGASVKVSCKASGNTFTNYYIHWVRQAPGQGLEWMGIINPSGGSTSYAQKLQGRMTMTRDTSTSTVYMELSSLRSEDTAVYFCARQGPFIGDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 693 - protein, 214 aa, Artificial Sequence
  Description of Artificial Sequence: Synthetic polypeptide
DIQMTQSPSSLSASVGDRVTITCRASQGISNYLAWFQQKPGKAPKSLIYAASSLQSGVPSKFSGSGSGTDFTLTISSLQPEDFATYYCQQYNSYPYTFAQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 694 - protein, 476 aa, Artificial Sequence
  Description of Artificial Sequence: Synthetic polypeptide
DIQMTQSPSSLSASVGDRVTITCRASQGISNYLAWFQQKPGKAPKSLIYAASSLQSGVPSKFSGSGSGTDFTLTISSLQPEDFATYYCQQYNSYPYTFAQGTKLEIKGGSEGKSSGSGSESKSTGGSQVQLVQSGAEVKKPGASVKVSCKASGNTFTNYYIHWVRQAPGQGLEWMGIINPSGGSTSYAQKLQGRMTMTRDTSTSTVYMELSSLRSEDTAVYFCARQGPFIGDAFDIWGQGTMVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLS

SEQ ID NO: 695 - protein, 479 aa, Artificial Sequence
  Description of Artificial Sequence: Synthetic polypeptide
DIQMTQSPSSLSASVGDRVTITCRASQGISNYLAWFQQKPGKAPKSLIYAASSLQSGVPSKFSGSGSGTDFTLTISSLQPEDFATYYCQQYNSYPYTFGQGTKLEIKGGSEGKSSGSGSESKSTGGSQVQLVQSGAEVKKPGASVKVSCKASGQTFTNYYIHWVRQAPGQGLEWMGIINPSGGSTSYAQKLQGRMTMTRDTSTSTVYMELSSLRSEDTAVYFCARQGPFIGDAFDIWGQGTTVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 696 - protein, 450 aa, Artificial Sequence
  Description of Artificial Sequence: Synthetic polypeptide
QVQLQQSGPRLVRPSQTLSLTCAISGDSVFNNNAAWSWIRQSPSRGLEWLGRTYYRSKWLYDYAVSVKSRITVNPDTSRNQFTLQLNSVTPEDTALYYCARGYSSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 697 - protein, 479 aa, Artificial Sequence
  Description of Artificial Sequence: Synthetic polypeptide
DIQMTQSPSSLSASVGDRVTITCRASQGISNYLAWFQQKPGKAPKSLIYAASSLQSGVPSKFSGSGSGTDFTLTISSLQPEDFATYYCQQYNSYPYTFGQGTKLEIKGGSEGKSSGSGSESKSTGGSQVQLVQSGAEVKKPGASVKVSCKASGQTFTNYYIHWVRQAPGQGLEWMGIINPSGGSTSYAQKLQGRMTMTRDTSTSTVYMELSSLRSEDTAVYFCARQGPFIGDAFDIWGQGTTVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 698 - skipped

SEQ ID NO: 699 - protein, 5 aa, Artificial Sequence
  Description of Artificial Sequence: Synthetic peptide
NYYIH

SEQ ID NO: 700 - protein, 17 aa, Artificial Sequence
  Description of Artificial Sequence: Synthetic peptide
IINPSGGSTSYAQKLQG

SEQ ID NO: 701 - protein, 11 aa, Artificial Sequence
  Description of Artificial Sequence: Synthetic peptide
QGPFIGDAFDI

SEQ ID NO: 702 - protein, 11 aa, Artificial Sequence
  Description of Artificial Sequence: Synthetic peptide
RASQGISNYLA

SEQ ID NO: 703 - protein, 7 aa, Artificial Sequence
  Description of Artificial Sequence: Synthetic peptide
AASSLQS

SEQ ID NO: 704 - protein, 9 aa, Artificial Sequence
  Description of Artificial Sequence: Synthetic peptide
QQYNSYPYT

SEQ ID NO: 705 - DNA, 1347 bp, Artificial Sequence
  Description of Artificial Sequence: Synthetic polynucleotide
caggttcagttggtccagagtggtgccgaagtaaagaagcccggagcatccgtaaaggtgtcctgtaaagccagtggcaatactttcactaactattacatccattgggtccgacaagcccccggacaaggattggagtggatgggtattatcaacccctccggtgggtctacttcttacgctcaaaaactccagggccgaatgacaatgacacgcgacacctcaacttcaaccgtttacatggagcttagcagtcttcgatctgaggacactgctgtttacttttgcgctaggcaggggcctttcataggagacgcttttgacatctgggggcaaggaacaatggtcactgtcagttccgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 706 - DNA, 642 bp, Artificial Sequence
  Description of Artificial Sequence: Synthetic polynucleotide
gacatccagatgacccagagccctagctctttaagcgctagcgtgggcgatcgtgtgaccatcacttgtcgtgccagccaaggtatcagcaactatttagcttggttccagcagaagcccggcaaggctcccaagtctttaatctatgccgctagctctttacagagcggagtgcccagcaagtttagcggcagcggtagcggaaccgacttcactttaaccatcagctctctgcagcccgaggacttcgccacctactactgccagcagtacaacagctacccctacaccttcgcccaaggtaccaagctggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 707 - DNA, 1434 bp, Artificial Sequence
  Description of Artificial Sequence: Synthetic polynucleotide
gatattcagatgacacagtctccatccagcttgtcagcaagcgtgggtgatagggttaccatcacttgtcgcgcaagtcaaggaattagtaactatttggcatggtttcagcagaaacccggtaaggctccaaaatcactcatatatgcagcatcctccctccagtctggtgttccaagtaagttttccgggagcggttccggcaccgatttcactctcacaatctctagccttcaacccgaggacttcgctacctattattgccaacagtataatagctacccatacacttttgctcaagggaccaaactcgagatcaaaggcggctccgagggcaagagcagcggcagcggcagcgagagcaagagcaccggcggcagccaggttcagttggtccagagtggtgccgaagtaaagaagcccggagcatccgtaaaggtgtcctgtaaagccagtggcaatactttcactaactattacatccattgggtccgacaagcccccggacaaggattggagtggatgggtattatcaacccctccggtgggtctacttcttacgctcaaaaactccagggccgaatgacaatgacacgcgacacctcaacttcaaccgtttacatggagcttagcagtcttcgatctgaggacactgctgtttacttttgcgctaggcaggggcctttcataggagacgcttttgacatctgggggcaaggaacaatggtcactgtcagttccgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 708 - DNA, 1437 bp, Artificial Sequence
  Description of Artificial Sequence: Synthetic polynucleotide
gacatccagatgacccagtctccatcctctctgtccgcctctgtgggcgacagagtgaccatcacctgtagagcctctcagggcatctccaactacctggcctggttccagcagaagcctggcaaggctcccaagagcctgatctacgctgcttccagtctgcagtctggcgtgccctctaagttctccggctctggctctggcaccgactttaccctgacaatctccagcctgcagcctgaggacttcgccacctactactgccagcagtacaacagctacccctacacctttggccagggcaccaagctggaaatcaagggcggctccgagggcaagagcagcggcagcggcagcgagagcaagagcaccggcggcagccaggttcagctggttcagtctggcgccgaagtgaagaaacctggcgcctctgtgaaggtgtcctgcaaggcttctggacagaccttcaccaactactacatccactgggtccgacaggcccctggacaaggattggagtggatgggcatcatcaacccttccggcggctctacctcttacgcccagaaactgcagggcagaatgaccatgaccagagacacctccaccagcaccgtgtacatggaactgtccagcctgagatccgaggataccgccgtgtacttctgtgccagacagggaccttttatcggcgacgccttcgacatctggggccagggaacaacagtgaccgtgtcctctgagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 709 - DNA, 1437 bp, Artificial Sequence
  Description of Artificial Sequence: Synthetic polynucleotide
gacatccagatgacccagtctccatcctctctgtccgcctctgtgggcgacagagtgaccatcacctgtagagcctctcagggcatctccaactacctggcctggttccagcagaagcctggcaaggctcccaagagcctgatctacgctgcttccagtctgcagtctggcgtgccctctaagttctccggctctggctctggcaccgactttaccctgacaatctccagcctgcagcctgaggacttcgccacctactactgccagcagtacaacagctacccctacacctttggccagggcaccaagctggaaatcaagggcggctccgagggcaagagcagcggcagcggcagcgagagcaagagcaccggcggcagccaggttcagctggttcagtctggcgccgaagtgaagaaacctggcgcctctgtgaaggtgtcctgcaaggcttctggacagaccttcaccaactactacatccactgggtccgacaggcccctggacaaggattggagtggatgggcatcatcaacccttccggcggctctacctcttacgcccagaaactgcagggcagaatgaccatgaccagagacacctccaccagcaccgtgtacatggaactgtccagcctgagatccgaggataccgccgtgtacttctgtgccagacagggaccttttatcggcgacgccttcgacatctggggccagggaacaacagtgaccgtgtcctctgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 710 - DNA, 1422 bp, Artificial Sequence; identical to SEQ ID NO: 353
  Description of Artificial Sequence: Synthetic polynucleotide

SEQ ID NO: 711 - DNA, 1422 bp, Artificial Sequence
  Description of Artificial Sequence: Synthetic polynucleotide
gaggtgcaactggtggagtctgggggaggcctggtcaagcctggggggtccctgagactctcctgtgcagcctctggattcaccttcagtagatataacatgaactgggtccgccaggctccagggaaggggctggagtgggtctcatccattagtactagtagtaattacatatactacgcagactcagtgaagggccgattcaccttctccagagacaacgccaagaactcactggatctgcaaatgagcggcctgagagccgaggacacggctatttattactgtacgagaggctgggggccttttgactactggggccagggaaccctggtcaccgtctcctcaggcggctccgagggcaagagcagcggcagcggcagcgagagcaagagcaccggcggcagcgacatacaaatgacacaatcaccctcttctctttctgcaagcgttggcgaccgtgtcactatcacttgtcgagcccgccagtccataggtactgccattcactggtatcaacagaagcctggcaaggctcccaaactcctgattaagtatgccagcgagagcatttccggcgtaccttcaagattttccggctccggtagtgggacagatttcactctcactatatctagcctccaaccagaagatttcgccacttactactgtcaacaatcaggttcatggccttacactttcggccaggggacaaaattggagatcaaggagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 712 - DNA, 1335 bp, Artificial Sequence
  Description of Artificial Sequence: Synthetic polynucleotide
gaggtgcaactggtggagtctgggggaggcctggtcaagcctggggggtccctgagactctcctgtgcagcctctggattcaccttcagtagatataacatgaactgggtccgccaggctccagggaaggggctggagtgggtctcatccattagtactagtagtaattacatatactacgcagactcagtgaagggccgattcaccttctccagagacaacgccaagaactcactggatctgcaaatgagcggcctgagagccgaggacacggctatttattactgtacgagaggctgggggccttttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 713 - DNA, 642 bp, Artificial Sequence
  Description of Artificial Sequence: Synthetic polynucleotide
gacatacaaatgacacaatcaccctcttctctttctgcaagcgttggcgaccgtgtcactatcacttgtcgagcccgccagtccataggtactgccattcactggtatcaacagaagcctggcaaggctcccaaactcctgattaagtatgccagcgagagcatttccggcgtaccttcaagattttccggctccggtagtgggacagatttcactctcactatatctagcctccaaccagaagatttcgccacttactactgtcaacaatcaggttcatggccttacactttcggccaggggacaaaattggagatcaagcggacagtggccgctccttccgtgttcatcttcccaccttccgacgagcagctgaagtccggcacagcttctgtcgtgtgcctgctgaacaacttctaccctcgggaagccaaggtgcagtggaaggtggacaatgccctgcagtccggcaactcccaagagtctgtgaccgagcaggactccaaggacagcacctacagcctgtcctccacactgaccctgtccaaggccgactacgagaagcacaaggtgtacgcctgcgaagtgacccatcagggcctgtctagccctgtgaccaagtctttcaaccggggcgagtgt

SEQ ID NO: 714 - DNA, 1350 bp, Artificial Sequence
  Description of Artificial Sequence: Synthetic polynucleotide
caggtgcagctgcagcagtctggccctagactcgtgcggccttcccagaccctgtctctgacctgtgccatctccggcgactccgtgttcaacaacaacgccgcctggtcctggatccggcagtctccatctcgcggtctggagtggctcggtcgcacctactaccgctctaaatggctgtacgactacgccgtgtccgtgaagtcccggatcaccgtgaaccctgacacctcccggaaccagttcaccctgcagctgaactccgtgacccctgaggacaccgccctgtactactgcgccagaggctactcctcctccttcgactattggggccaaggcaccctcgtgaccgtgtcctctgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagccgccgggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtcgaacaaagccctcccagcccccatcgagaaaaccatctccaaagccaaagggcagccccgagaaccacaggtgtacaccctgcccccatcccgggaggagatgaccaagaaccaggtcagcctgtcctgcgccgtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcagatggcagcaggggaacgtcttctcatgctccgtgatgcatgaggctctgcacaaccggttcacgcagaagtctctctccctgtctccgggaaaa

SEQ ID NO: 715 - DNA, 648 bp, Artificial Sequence; identical to SEQ ID NO: 352
  Description of Artificial Sequence: Synthetic polynucleotide

SEQ ID NO: 716 - protein, 618 aa, Homo sapiens
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREVATPLFPPLHTGRAGQRQHLLFPYPSSILSVK

SEQ ID NO: 717 - protein, 475 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 718 - protein, 475 aa, Artificial Sequence; identical to SEQ ID NO: 331
  Description of Artificial Sequence: Synthetic polypeptide

SEQ ID NO: 719 - protein, 446 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 720 - protein, 11 aa, Artificial Sequence
  Description of Artificial Sequence: Synthetic peptide
GGDNIGSKSVH

SEQ ID NO: 721 - protein, 7 aa, Artificial Sequence
  Description of Artificial Sequence: Synthetic peptide
DNSDRPS

SEQ ID NO: 722 - DNA, 642 bp, Artificial Sequence
  Description of Artificial Sequence: Synthetic polynucleotide
gatattcaaatgacccagtcaccatcattcctgtccgcctcagtgggagatcgcgtcactattacttgtcgtgctagccaggggatatcatcatatttggcttggtatcaacaaaagccaggaaaggccccaaaattccttatatatgcagctagtacactccagagtggtgttcctagccggttctctggcagcggctcagggaccgagttcaccctgacaatctccagcttgcagcccgaagactttgcaacctactattgccagcaactgaactcctatcctctgactttcgggggaggaaccaaggttgagattaaacggacagtggccgctccttccgtgttcatcttcccaccttccgacgagcagctgaagtccggcacagcttctgtcgtgtgcctgctgaacaacttctaccctcgggaagccaaggtgcagtggaaggtggacaatgccctgcagtccggcaactcccaagagtctgtgaccgagcaggactccaaggacagcacctacagcctgtcctccacactgaccctgtccaaggccgactacgagaagcacaaggtgtacgcctgcgaagtgacccatcagggcctgtctagccctgtgaccaagtctttcaaccggggcgagtgt

SEQ ID NO: 723 - DNA, 642 bp, Artificial Sequence
  Description of Artificial Sequence: Synthetic polynucleotide
gatattgtaatgactcagtcaccctcttcactgagtgcatcagtaggtgatcgcgttaccatcacttgccgtgccagtcaagacatttcaaattaccttgcatggtaccaacaaaagcccggaaaagtgccaaagtttttgatttatgccgcttcaacactccattcaggagtgccctctcgtttcagtggatctggcagtggcaccgattttactctcacaataagcagtctccagcctgaggatgtagccacctattattgccaaaaatataattcagccccctatacttttggacagggcacacgccttgagattaaacggacagtggccgctccttccgtgttcatcttcccaccttccgacgagcagctgaagtccggcacagcttctgtcgtgtgcctgctgaacaacttctaccctcgggaagccaaggtgcagtggaaggtggacaatgccctgcagtccggcaactcccaagagtctgtgaccgagcaggactccaaggacagcacctacagcctgtcctccacactgaccctgtccaaggccgactacgagaagcacaaggtgtacgcctgcgaagtgacccatcagggcctgtctagccctgtgaccaagtctttcaaccggggcgagtgt

SEQ ID NO: 724 - DNA, 363 bp, Artificial Sequence; identical to SEQ ID NO: 362
  Description of Artificial Sequence: Synthetic polynucleotide

SEQ ID NO: 725 - DNA, 1335 bp, Artificial Sequence; identical to SEQ ID NO: 712
  Description of Artificial Sequence: Synthetic polynucleotide

SEQ ID NO: 726 - DNA, 642 bp, Artificial Sequence; identical to SEQ ID NO: 713
  Description of Artificial Sequence: Synthetic polynucleotide

SEQ ID NO: 727 - protein, 450 aa, Artificial Sequence
  Description of Artificial Sequence: Synthetic polypeptide
QVQLQQSGPRLVRPSQTLSLTCAISGDSVFNNNAAWSWIRQSPSRGLEWLGRTYYRSKWLYDYAVSVKSRITVNPDTSRNQFTLQLNSVTPEDTALYYCARGYSSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGK

SEQ ID NO: 728 - protein, 8 aa, Artificial Sequence
  Description of Artificial Sequence: Synthetic peptide
YYSTPRMY

SEQ ID NO: 729 - protein, 6 aa, Artificial Sequence
  Description of Artificial Sequence: Synthetic peptide
GFTFSH

SEQ ID NO: 730 - protein, 17 aa, Artificial Sequence
  Description of Artificial Sequence: Synthetic peptide
TAVYYCAKPHIVMVTAL

SEQ ID NO: 731 - protein, 13 aa, Artificial Sequence
  Description of Artificial Sequence: Synthetic peptide
YDDSDRPSGIPER

SEQ ID NO: 732 - protein, 5 aa, Artificial Sequence
  Description of Artificial Sequence: Synthetic peptide
FTFSY

SEQ ID NO: 733 - protein, 8 aa, Artificial Sequence
  Description of Artificial Sequence: Synthetic peptide
GSYWAFDY

SEQ ID NO: 734 - protein, 4 aa, Artificial Sequence
  Description of Artificial Sequence: Synthetic peptide
DNSD

SEQ ID NO: 735 - protein, 9 aa, Artificial Sequence
  Description of Artificial Sequence: Synthetic peptide
GNSITSDYA

SEQ ID NO: 736 - protein, 4 aa, Artificial Sequence
  Description of Artificial Sequence: Synthetic peptide
GFTF

SEQ ID NO: 737 - protein, 9 aa, Artificial Sequence
  Description of Artificial Sequence: Synthetic peptide
ARDQNYDIL

SEQ ID NO: 738 - protein, 5 aa, Artificial Sequence
  Description of Artificial Sequence: Synthetic peptide
VTPNF

SEQ ID NO: 739 - protein, 9 aa, Artificial Sequence
  Description of Artificial Sequence: Synthetic peptide
YAASTLQSG

SEQ ID NO: 740 - protein, 7 aa, Artificial Sequence
  Description of Artificial Sequence: Synthetic peptide
ESGWSHY

SEQ ID NO: 741 - protein, 244 aa, Artificial Sequence
  Description of Artificial Sequence: Synthetic polypeptide
VPLIEGRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGGDSGGPLVCNGVLQGITSWGPEPCALPEKPAVYTKVVHYRKWIKDTIAANP

SEQ ID NO: 742 - protein, 451 aa, Artificial Sequence
  Description of Artificial Sequence: Synthetic polypeptide
EVQLVESGGGLVQPGGSLRLSCAASGFTFSSYWMTWVRQPPGKGLEWVANIKQDGSERYFVDSVKGRFTISRDNAKNSLYLQMNSLRAEDTAVYYCARDQNYDILTGHYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 743 - protein, 214 aa, Artificial Sequence
  Description of Artificial Sequence: Synthetic polypeptide
EIVLTQSPSFLSASVGDRVTITCRASQGISSYLSWYQQKPGKAPKLLIYATSTLQSGVPSRFSGSGSGTEFTLTISSLQPEDFATYYCQQLNSYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 744 - protein, 92 aa, Artificial Sequence
  Description of Artificial Sequence: Synthetic polypeptide
DPPKTHVTHHPVFDYEATLRCWALGFYPAEIILTWQRDGEDQTQDVELVETRPAGDGTFQKWAAVVVPSGEEQRYTCHVQHEGLPEPLMLRW

SEQ ID NO: 745 - protein, 244 aa, Artificial Sequence; identical to SEQ ID NO: 741
  Description of Artificial Sequence: Synthetic polypeptide

SEQ ID NO: 746 - protein, 92 aa, Artificial Sequence; identical to SEQ ID NO: 744
  Description of Artificial Sequence: Synthetic polypeptide

SEQ ID NO: 747 - protein, 474 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 748 - protein, 474 aa, Artificial Sequence
  Description of Artificial Sequence: Synthetic polypeptide
DIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 749 - protein, 474 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 750 - protein, 474 aa, Artificial Sequence
  Description of Artificial Sequence: Synthetic polypeptide
DIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 751 - protein, 474 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIYYASESISGVPSRFSGSGSGTDFTLTISSLQPEDFATYYCQQSGSWPYTFGQGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 752 - protein, 474 aa, Artificial Sequence
  Description of Artificial Sequence: Synthetic polypeptide
DIQMTQSPSSLSASVGDRVTITCRARQSIGTAIHWYQQKPGKAPKLLIYYASESISGVPSRFSGSGSGTDFTLTISSLQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 753 - protein, 474 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 754 - protein, 474 aa, Artificial Sequence
  Description of Artificial Sequence: Synthetic polypeptide
DILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

What is claimed:

1. An isolated protein comprising an antigen binding domain that binds to cluster of differentiation 3ε (CD3ε), wherein the antigen binding domain that binds CD3ε comprises a heavy chain complementarity determining region (HCDR) 1, a HCDR2 and a HCDR3 of a heavy chain variable region (VH) of SEQ ID NO: 23 and a light chain complementarity determining region (LCDR) 1, a LCDR2 and a LCDR3 of a light chain variable region (VL) of SEQ ID NO: 28.

2. The isolated protein of claim 1, comprising the HCDR1, the HCDR2, the HCDR3, the LCDR1, the LCDR2 and the LCDR3 of a. SEQ ID NOs: 6, 7, 8, 9, 10, and 11, respectively;

b. SEQ ID NOs: 12, 13, 14, 15, 16, and 17, respectively; or c. SEQ ID NOs: 18, 19, 20, 21, 16, and 22, respectively.

3. The isolated protein of claim 1 comprising an amino acid sequence selected from the group consisting of SEQ ID NOs: 77 and 78.

4. The isolated protein of claim 1 comprising the amino acid sequence of SEQ ID NO: 77.

5. The isolated protein of claim 1 comprising the amino acid sequence of SEQ ID NO: 78.

6. The isolated protein of claim 1 comprising the amino acid sequences of SEQ ID NOs: 85 and 88.

7. The isolated protein of claim 1, wherein the antigen binding domain that binds CD3ε is a scFv, a (scFv) 2, a Fv, a Fab, or a F (ab')2.

8. The isolated protein of claim 7, wherein the antigen binding domain that binds CD3ε is the Fab.

9. The isolated protein of claim 7, wherein the antigen binding domain that binds CD3ε is the scFv.

10. The isolated protein of claim 9, wherein the scFv comprises, from the N- to C-terminus, a VH, a first linker (L1) and a VL (VH-L1-VL) or the VL, the L1 and the VH (VL-L1-VH).

11. The isolated protein of claim 10, wherein the L1 comprises a. about 5-50 amino acids;

b. about 5-40 amino acids;

c. about 10-30 amino acids; or d. about 10-20 amino acids.

12. The isolated protein of claim 10, wherein the L1 comprises an amino acid sequence of SEQ ID NOs: 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, or 64.

13. The isolated protein of claim 12, wherein the L1 comprises the amino acid sequence of SEQ ID NOs: 31, 37, or 64.

14. The isolated protein of claim 1, wherein the antigen binding domain that binds CD3ε comprises the amino acid sequence of SEQ ID NOs: 67 or 68.

15. The isolated protein of claim 1, wherein the antigen binding domain that binds CD3ε comprises the VH of SEQ ID NO: 23 and the VL of SEQ ID NO: 28.

16. The isolated protein of claim 15, wherein the antigen binding domain that binds CD3ε is a scFv, a (scFv) 2, a Fv, a Fab, or a F (ab')2.

17. The isolated protein of claim 16, wherein the antigen binding domain that binds CD3ε is the Fab.

18. The isolated protein of claim 16, wherein the antigen binding domain that binds CD3ε is the scFv.

19. The isolated protein of claim 18, wherein the scFv comprises, from the N- to C-terminus, a VH, a first linker (L1) and a VL (VH-L1-VL) or the VL, the LH and the VH (VL-L1-VH).

20. The isolated protein of claim 19, wherein the L1 comprises a. about 5-50 amino acids;

b. about 5-40 amino acids;

c. about 10-30 amino acids; or d. about 10-20 amino acids.

21. The isolated protein of claim 20, wherein the L1 comprises an amino acid sequence of SEQ ID NOs: 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, or 64.

22. The isolated protein of claim 21, wherein the L1 comprises the amino acid sequence of SEQ ID NOs: 31, 37, or 64.

23. The isolated protein of claim 1, wherein the isolated protein is a multispecific protein.

24. The isolated protein of claim 23, wherein the multispecific protein is a bispecific protein.

25. The isolated protein of claim 23, wherein the multispecific protein is a trispecific protein.

26. The isolated protein of claim 23, wherein the multispecific protein comprises an antigen binding domain that binds an antigen other than CD3ε.

27. The multispecific antibody of claim 26, wherein the antigen other than CD3ε is a tumor associated antigen.

28. The isolated protein of claim 1, further comprising an immunoglobulin (Ig) constant region or a fragment of the Ig constant region thereof.

29. The isolated protein of claim 28, wherein the fragment of the Ig constant region comprises a Fc region.

30. The isolated protein of claim 28, wherein the fragment of the Ig constant region comprises a CH2 domain.

31. The isolated protein of claim 28, wherein the fragment of the Ig constant region comprises a CH3 domain.

32. The isolated protein of claim 28, wherein the fragment of the Ig constant region comprises a CH2 domain and a CH3 domain.

33. The isolated protein of claim 28, wherein the fragment of the Ig constant region comprises at least a portion of a hinge, a CH2 domain and a CH3 domain.

34. The isolated protein of claim 28, wherein the fragment of the Ig constant region comprises a hinge, a CH2 domain and a CH3 domain.

35. The isolated protein of claim 28, wherein the antigen binding domain that binds CD3ε is conjugated to the N-terminus of the Ig constant region or the fragment of the Ig constant region.

36. The isolated protein of claim 28, wherein the antigen binding domain that binds CD3ε is conjugated to the C-terminus of the Ig constant region or the fragment of the Ig constant region.

37. The isolated protein of claim 28, wherein the antigen binding domain that binds CD3ε is conjugated to the Ig constant region or the fragment of the Ig constant region via a second linker (L2).

38. The isolated protein of claim 37, wherein the L2 comprises the amino acid sequence of SEQ ID NOs: 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, or 64.

39. The isolated protein of claim 28, wherein the Ig constant region or the fragment of the Ig constant region is an IgG1, an IgG2, an IgG3 or an IgG4 isotype.

40. The isolated protein of claim 28, wherein the Ig constant region of the fragment of the Ig constant region comprises at least one mutation that results in reduced binding of the protein to a Fcγ receptor (FcγR).

41. The isolated protein of claim 40, wherein the at least one mutation that results in reduced binding of the protein to the FcγR is selected from the group consisting of F234A/L235A, L234A/L235A, L234A/L235A/D265S, V234A/G237A/P238S/H268A/V309L/A330S/P331S, S228P/F234A/L235A, N297A, V234A/G237A, K214T/E223P/L234V/L235A/G236-deleted/A327G/P331A/D365E/L358M, H268Q/V309L/A330S/P331S, S267E/L328F, L234F/L235E/D265A, L234A/L235A/G237A/P238S/H238A/A330S/P331S, S228P/F234A/L235A/G237A/P238S and S228P/F234A/L235A/G236-deleted/G237A/P238S, wherein residue numbering is according to the EU index.

42. The isolated protein of claim 40, wherein the FcγR is FcγRI, FcγRIIA, FcγRIIB or FcγRIII, or any combination thereof.

43. The isolated protein of claim 28, wherein the protein comprises at least one mutation in the CH3 domain of the Ig constant region.

44. The isolated protein of claim 43, wherein the at least one mutation in the CH3 domain of the Ig constant region is selected from the group consisting of T350V, L351Y, F405A, Y407V, T366Y, T366W, T366L, F405W, T394W, K392L, T294S, Y407T, Y407A, T336S/L368A/Y407V, L351Y/F405A/Y407V, T366I/K392M/T394W, F405A/Y407V, T336L/K392M/T394W, T366L/K392L/T394W, L351Y/Y407V, T366A/K409F, T366V/K409F, T350V/L351Y/F405A/Y407V and T350V/T366L/K392L/T394W, wherein residue numbering is according to the EU index.

45. A pharmaceutical composition comprising the isolated protein of claim 1 and a pharmaceutically acceptable carrier.

46. A polynucleotide encoding the isolated protein of claim 1.

47. A vector comprising the polynucleotide of claim 46.

48. A host cell comprising the vector of claim 47.

49. A method of producing the isolated protein of claim 1, comprising culturing a host cell comprising a vector, wherein the vector comprises a polynucleotide encoding the isolated protein of claim 1, in conditions that the protein is expressed, and recovering the protein produced by the host cell.

50. A method of treating a cancer in a subject, comprising administering a therapeutically effective amount of the isolated antibody of claim 1 to the subject in need thereof to treat the cancer.

* * * * *